United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 30

SEQ ID NO: 33840 - DNA, 5293 bp, Homo sapiens
gaggcccgggcgccgcggctcttttgtttctccgttggggccgagcccgggccctagttggagccggagtcggagtcggagtcggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgagaagcacgatttggaggtcgccgtcaagtgcattaacaagaagaacctcgccaagtctcagacgctgctggggaaggaaatcaaaatcctgaaggaactgaaacatgaaaacatcgtggccctgtacgacttccaggaaatggctaattctgtctacctggttatggagtactgcaacggtggggacctggccgactacctgcacgccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcgctgacttcggcttcgcgcggtacctccagagcaacatgatggcggccacactctgcggctcccccatgtacatggcccccgaggtcatcatgtcccagcactacgacgggaaggcggacctgtggagcatcggcaccatcgtctaccagtgcctgacggggaaggcgcccttccaggccagcagcccccaggacctgcgcctgttctacgagaagaacaagacgttggtccccaccatcccccgggagacctcggccccgctgcggcagctgctcctggccctactgcaacgcaaccacaaggaccgcatggacttcgatgagttttttcatcaccctttcctcgatgccagcccctcggtcaggaaatccccacccgtgcctgtgccctcgtacccaagctcggggtccggcagcagctccagcagcagctccacctcccacctggcctccccgccgtccctgggcgagatgcagcagctgcagaagaccctggcctccccggctgacaccgctggcttcctgcacagctcccgggactctggtggcagcaaggactcttcctgtgacacagacgacttcgtcatggtccccgcgcagtttccaggtgacctggtggctgaggcgcccagtgccaaacccccgccagacagcctgatgtgcagtgggagctcactggtggcctctgcgggcttggagagccacggccggaccccatctccatccccaccctgcagcagctcccccagtccctcaggccgggctggcccgttctccagcagcaggtgcggcgcctctgtccccatcccagtccccacgcaggtgcagaactaccagcgcattgagcgaaacctgcagtcacccacccagttccaaacacctcggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaagttggaaccatccctgagcggccaggctggagcgggacgccctccccacagggagctgagatgcggggtggcaggtcccctcgtccaggctcctctgcacccgagcactctccccgcacttccgggctgggctgccgcctgcacagcgcccccaacctgtctgacttgcacgtcgtccgccccaagctgcccaaaccccccacggaccccctgggagctgtgttcagcccaccacaggccagccctccccagccgtcccacggcctgcagtcctgccggaacctgcggggctcacccaagctgcccgacttcctgcagcgaaaccccctgccccccatcctgggctcccccaccaaggctgtgccctcctttgacttcccgaagacccccagctcccagaacctgctggccctcctagcccggcagggcgtggtgatgacgccccctcgaaaccggacgctgcccgacctctcggaggtgggacccttccatggtcagccgttgggccctggcctgcggccaggcgaggaccccaagggcccctttggccggtctttcagcaccagccgcctcactgacctgctccttaaggcggcgtttgggacacaagccccggacccgggcagcacggagagcctgcaggagaagcccatggagatcgcaccctcagctggctttggagggagcctgcacccaggagcccgtgctgggggcaccagcagcccttccccggtggtcttcaccgtgggctctcccccgagcgggagcacgcccccccagggcccccgcaccaggatgttctcagcgggccccactggctctgccagctcttctgcccgccacctggtgcctgggccctgcagcgaggccccagcccctgagctccctgctccaggacacggctgcagctttgccgaccccattactgcgaacctggagggggctgtgaccttcgaggcccccgacctccctgaggagaccctcatggagcaagagcacacggagatcctgcgtggcctgcgcttcacgctgctgttcgtgcagcacgtcctggagatcgcagccctgaagggcagcgccagtgaggcggcggggggccctgagtaccagctgcaggagagtgtggtggccgaccagatcagcctgctgagccgagaatggggcttcgcggaacagctggtgctgtacctgaaggtggccgagctactgtcctccggcctgcaaagtgccatcgaccagatccgggccggcaagctctgcctgtcgtccactgtgaagcaggtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggaaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcatctgcagagaggcctgccttccggattccaggcgggcatgccctgcaaaccccgcctgggcctcccttggtctgcccagccctcgattagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgtt

SEQ ID NO: 33841 - DNA, 1631 bp, Homo sapiens
agaatgcaaagaaatggatcagctagccgagggttggagaagaccaggctgaggctgtgtcgggaagccaggattccagaatcagcattcctcactggcctcacaagggaaagctgggaagcccggtgctggtgtgcaaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatgaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttact

SEQ ID NO: 33842 - DNA, 2635 bp, Homo sapiens
cggcgctgggggcagcgtggagccacccagtgctcggcccgccccgcaacccgccggaaccgccgcccgcagcgaggaagcgcccgcgcgggcgcaggcggccggaatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatgaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgcccctggcctgcccttcccgggaccccttattccaactcagctcctctttgcactggaatggggcactccaacacccctcagggaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcacttatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggaggctgagtgtaaagagtatcattcattgtttctctattaaattattttctcta

SEQ ID NO: 33843 - DNA, 10702 bp, Homo sapiens
gggtcctgcagtaggactcccgggagccaccattatggtgaagaggaagagctccgagggccaggagcaggacggcggccgcggcatccccctgcccatccagaccttcctgtggcggcaaaccagtgcatttttgaggcccaaactggggaagcaatatgaagcttcttgtgtgtcctttgagcgagtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgtggagctcttcgtgtttctgtttgctcccctggtacacaggatcaaggaatctgacctcaccttccgtctggccagtgggcttgttatatggcagcccatgtgggaacacagacagcccggagtctctggctttaccgcactggtgaagcccatcaggaacatcattacagctaagagaagttctcctatcaacagtcaaagccggacctgtgaatcaccaaatcaagatgcaagacacttagagggactccaggtggtttgtgaaacattccagtctgattccatctcacccaaggccaccatttcaggctgtcaccgaggaaactcctttgatggaagtctgtcctcccaaacttcccaggaaagaggcccatcacattccagggcctctcttgtgatacctccgtgccaaaggtcccgctatgccacctactttgacgttgctgttctgcgctgcctacttcagccccattggtctgaggaaggcactcagtggtctctgatgtactatctacaaaggctgcgacacatgttggaagagaagccagaaaagcctccggagccagatattcctctcctgcccagacccaggagtagctccatggtggcagcagctccctcactagtgaacacccacaaaacccaagatctcaccatgaagtgtaacgaggaggaaaaatctcttagctctgaggccttttccaaggtttcactgaccaatctgcgtagatctgcagtcccagatctttcttcagacctgggcatgaatatttttaaaaagttcaagagccgcaaagaagaccgagagaggaaaggctccattccattccaccacacaggcaagaggaggccacggagaatgggagtgcccttcctgcttcacgaggaccacctggatgtgtcccccacgcgcagcacattctcctttggaagtttctctgggctgggagaagacaggcgaggaattgagaaaggaggctggcaaaccaccattttagggaaattgacccggcgaggcagttcagatgcagccactgagatggagagtctgagcgccaggcattcccactcccatcacaccctggtaagcgacctgccggacccctccaacagccatggagaaaacaccgtcaaggaagtgcgatctcagatctccaccatcacagttgcgaccttcaataccactttggcgtcattcaacgtaggctatgcagactttttcaatgagcatatgaggaaactctgcaaccaggtgcctatcccggagatgccacatgaacctctggcatgtgctaacctacctcgaagcctcacagactcctgcataaactacagctacctagaggacacagaacatattgacgggaccaataactttgtccacaagaatggaatgcttgatctttctgtagttctgaaggctgtttatcttgtccttaatcatgacatcagctctcgtatctgtgacgtggcgctaaacattgtggaatgcttgcttcaacttggtgtggtgccctgtgtagaaaagaatagaaagaagagtgaaaacaaggaaaatgagaccttggaaaagaggccaagtgagggagctttccaattcaaaggagtatctggaagttccacctgtggattcggaggccctgctgttagtggagctggagatggtggaggagaagaaggaggaggtggagatggaggaggtggaggaggtgatggaggaggaggtggaggaggtggaggcggcccttatgagaagaatgataagaaccaagagaaggatgaaagtacacctgtaagcaaccataggcttgctctaacaatgctcatcaaaatagtgaagtctttgggatgtgcctatggttgtggtgaaggacaccgagggctctctggagatcgtctgagacaccaggcccagaactgcctcactaagctatacaagctagataagatgcagttccgacaaaccatgagggactatgtgaacaaggactctctcaataatgtagtggacttcttgcatgctttgctaggattttgtatggagccggtcactgacaacaaggctgggtttggaaataacttcaccacagtggacaacaaatccacagcccaaaatgtggaaggcattatcgtcagcgccatgtttaaatccctcatcacacgctgcgcttcaaccacacatgaattgcacagccctgagaatctgggactgtattgtgacattcgtcagctggtccagtttatcaaagaggctcatgggaatgtcttcaggagagtggccctcagcgctctgcttgacagtgccgagaagttagcaccagggaaaaaggtggaggagaatgaacaggaatctaagcctgcaggcagtaaaaggtcagaggcgggaagcattgtggataaaggccaggtatcctctgcacctgaggaatgtcgcagcttcatgtctggtcgcccctcacagactccagagcacgatgaacaaatgcaaggagccaacttggggcggaaagatttctggcgtaagatgttcaagtcccagagtgcagcaagtgacaccagcagccagtctgaacaggacacttcagaatgcacgactgcccactcagggaccacctctgaccgacgtgcccgctcacgatcccgcagaatttccctccgaaagaagcttaaactccccataggtaaaaggaactggctgaagagatcatccctctcaggcctggcagatggtgtggaggacctcctggacattagctctgtggaccgactctctttcatcaggcaaagctccaaggtcaaattcactagtgctgtgaagctttctgaaggtgggccaggaagtggcatggaaaatggaagagatgaagaggagaatttcttcaagcgtcttggttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctagaagcccctgtggtggccagagcagccttgttcctggaatgtgctcgttttgttcaccgctgcaaccgtggcaactggccagagtggatgaaagggcaccacgtgaacatcaccaagaaaggactttcccggggacgctctcccattgtgggcaacaagcgaaaccagaagctgcagtggaatgcagccaagctcttctaccaatggggagacgcaattggcgtccgattgaatgagctgtgccacggggaaagtgagagcccagccaacctgctgggtctcatttacgatgaagagaccaagaggagacttagaaaggaggatgaggaggaagactttttagatgacagtactgtgaacccctctaaatgcggttgcccctttgccttgaagatggcagcatgtcagcttcttctggagattaccaccttcctgcgagagaccttttcttgcctgcccagacctcgcactgagcctctggtggacttggagagctgcagacttcgtttggatcccgagttggaccggcacagatatgagaggaagatcagctttgctggggtcctggacgaaaatgaagactcaaaagattctctccacagcagcagccacactctcaaatcagatgcaggagtcgaggagaagaaagaagggagtccttggagtgcaagcgagcccagcattgagccagagggaatgagtaatgccggcgcggaggagaattaccacagaaacatgtcgtggcttcatgtgatgatcttgctgtgcaatcagcagagtttcatctgcactcacgttgactactgccatccccactgctacctgcaccacagccgctcctgtgcccgactggtcagagccatcaagctactctatggagacagtgtggactccctgagggaaagcagcaacatcagcagtgtggctctccggggcaagaaacagaaagaatgctcagataagtcatgcctgaggacaccttctctaaagaagagagtttcagatgccaatctggaaggaaaaaaagattccggaatgctgaagtacatcagacttcaggtgatgagcttgtcgcctgctcccttatctctgttaatcaaggcagcaccaattctgacagaggagatgtacggagacatccagccagctgcctgggagctcctgctcagcatggatgagcacatggcaggggcagcagctgccatgttcctgctgtgtgcagtgaaggtgcctgaggccgtgtccgacatgctgatgtcagagttccaccacccggagactgtgcagaggctgaacgctgtcctcaagttccacacgctctggaggtttcgctatcaggtctggccccggatggaggaaggggcacagcagatttttaagattccgcctcccagtatcaatttcacccttccctcgccggtgcttggaatgccatccgtcccaatgtttgacccaccgtgggttcctcagtgcagcgggagtgtccaggaccccattaatgaagaccagtctaaatccttttcagcccgggctgtgtcccgctcccatcaaagggcagaacacatcttaaagaacttgcagcaggaggaagaaaagaaacgacttggtagagaagccagcctcatcactgccatccccatcacccaggaggcttgctatgagcccacatgcacgcccaactcagaaccggaagaagaagtagaagaagtcaccaatctggcatcccgtcgactgtctgtgagtccatcctgcacctccagcacttcccacaggaattattccttccgccgcgggtcagtctggtcagtgcgttcagccgtcagtgctgaagatgaggaacataccactgaacacacgccgaaccaccatgtgcctcagcccccacaagcagtgttcccagcatgcatctgtgcagcagtacttcccattgttcatctgatggaggatggtgaggtgcgggaagatggagtagcagtgagtgctgtggctcaacaagtcttatggaactgtctaattgaagatccatcaacggttcttcgacattttctggaaaaactgaccatcagcaatagacaagatgagttaatgtacatgctgcgcaaacttctcttgaatattggagactttcctgctcagacatctcacatcctattcaactatttggtaggattaatcatgtactttgtgcggaccccctgcgagtgggggatggatgccatttcagccaccctgacattcctgtgggaggtggtgggttacgtggagggcctcttcttcaaggatctcaagcagacgatgaagaaggagcagtgtgaggtgaagctcctggtgaccgcttcaatgccaggtactaaaaccttggtagttcatggacagaatgagtgcgatatcccaacccagttaccagtccatgaagacactcaatttgaagccctgttgaaggagtgtctggagttttttaatatcccagaatcccagtcaacacattattttcttatggataaacgatggaaccttatccactacaataagacctatgttcgagatatttatcctttccggaggtcagtatctccccagctgaatcttgtacatatgcatccagagaagggacaggagctcattcagaaacaggtgttcacccgaaagctggaagaagtagggcgggtgttgtttctcatctccctaacccagaagatccccacagcccacaaacagtcccacgtctccatgcttcaggaagacctcctccgcctgccctcattccctcgtagtgctattgatgctgagttttcactcttcagtgatcctcaagctggaaaggaactgtttggcctcgacactcttcagaaaagcttgtggatccagctgctggaggaaatgttcctgggcatgccgagcgagtttccatggggagacgaaatcatgcttttcctcaacgtttttaacggggctctgatcctccacccggaagacagtgccctgctcaggcagtatgctgccaccgtcatcaacaccgcggtgcacttcaaccacctcttctctctcagcggctaccagtggattctccccaccatgctgcaggtgtactccgactatgaaagcaatccccagctgcgtcaagccatcgaatttgcctgtcaccagttctatattctacaccggaagccctttgtgctccagctgtttgctagtgtggcccctctcctggaatttcctgatgctgccaataatgggcccagcaaaggtgtgtcagctcagtgcctgtttgacttgctgcagtccctagagggagagaccaccgacatattagacatcttagagctggtcaaagctgagaagcctctcaagtcattagatttctgctatggaaacgaagatctgacattttctatcagtgaagccattaagctctgtgtcactgtggtggcgtatgctcccgaatcattcagaagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccaggcccatgacagccccacagatgagcaggtgtgaccaaggtcataagggaaccaccacagccaatcacaccatgtcgtctggggtgaacaccaggtaccaggaacaaggagccaaactgcactttatcagggaaaaccttcatttactggaggaagggcaaggcattcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagagggtggcaagtatacagagtgaacctggtcaacagaacctccttgttcagcagccgctggggaggaagaggggcctgaggcagctaagacgtcctctactatcacgtcagaaaactcagactgaacccagaaatcgccaaggggctcggctgtcaaccactcgcaggagcattcaacctaaaacgaagccgtctgcggatcagaaacgatctgtgaccttcattgaggctcagccagagccagcagctgccccaacagatgcgcttcctgcaacaggccaactacagggctgtagcccagccccttctaggaaaccagaagcaatggacgaaccagtcctcacatcttctcccgccatagttgttgcggatctccacagcgtgtctcccaagcagagtgagaacttccccactgaagaaggagaaaaggaggaggacacagaagcacaaggtgctactgcacacagtccactctctgcccaactctctgaccctgatgacttcacaggcctcgagacatccagcctcctacagcatggagacactgtccttcatatcagtgaggaaaatggcatggagaacccgctactatctagtcagttcacctttactcccactgagctggggaaaacggatgcagtattagatgagtctcatgtttaattctgtatcttgtaagctctgcaggtatagagaagacatgaaagtgatctctctactacaagttcaatacttttgcttgaaaaagattaattacaaaatagcactttacttctaatgggtggcacaaatctgaataggttttgctgccaatacacatgatgtttcataaacatcttaaaagtcaatggctaaaaggatttagttgtgtgaaaatcacaaaaccagggaggaataaggggaaagagccatttcactgcacattgtttatgattcaagaagccttcagcagttaaaaatatatactattcattgctgctttcatagaaatattaacaaatgatatgatctaaaaatagaatgcaattttttgagattactcacattatacatctcatgcaaatatttatttttatagtttaaaaaatatcaattcaggttggctatacaagtagcaatttacataaaaaaataattaataggaaaaatattactttggggagactaaataacaagcctgcagccatttttgttttgagtaacaatacagccatttagaagaagaaaaaaatactatatagagagctgtggacttttagatatttatttttcaactatcattttcattgcatgttgtaaatcaaaatgcagatggcataagatcatcccatttcataatctatcacattagaatattacagaatattctagaaatcatcagaaataattctgaattaagaacctaaacagcctatacaattataaaaactaaatgtatatataatcacttaaaagagatggtattcctattcctagccctgactacatcaataccaagattagaagctattggaaaatgtgattagtaatacttttccttatagtatcctgtgcctgccctggagggcatattttcagatattaaggttagtgttgttagaatcggtttaataaaataacattttc

SEQ ID NO: 33844 - DNA, 13562 bp, Homo sapiens
agcagcgggaggaggcggcggcggcggctagcgaggagacagagctgggtcctgcagtaggactcccgggagccaccattatggtgaagaggaagagctccgagggccaggagcaggacggcggccgcggcatccccctgcccatccagaccttcctgtggcggcaaaccagtgcatttttgaggcccaaactggggaagcaatatgaagcttcttgtgtgtcctttgagcgagtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgtggagctcttcgtgtttctgtttgctcccctggtacacaggatcaaggaatctgacctcaccttccgtctggccagtgggcttgttatatggcagcccatgtgggaacacagacagcccggagtctctggctttaccgcactggtgaagcccatcaggaacatcattacagctaagagaagttctcctatcaacagtcaaagccggacctgtgaatcaccaaatcaagatgcaagacacttagagggactccaggtggtttgtgaaacattccagtctgattccatctcacccaaggccaccatttcaggctgtcaccgaggaaactcctttgatggaagtctgtcctcccaaacttcccaggaaagaggcccatcacattccagggcctctcttgtgatacctccgtgccaaaggtcccgctatgccacctactttgacgttgctgttctgcgctgcctacttcagccccattggtctgaggaaggcactcagtggtctctgatgtactatctacaaaggctgcgacacatgttggaagagaagccagaaaagcctccggagccagatattcctctcctgcccagacccaggagtagctccatggtggcagcagctccctcactagtgaacacccacaaaacccaagatctcaccatgaagtgtaacgaggaggaaaaatctcttagctctgaggccttttccaaggtttcactgaccaatctgcgtagatctgcagtcccagatctttcttcagacctgggcatgaatatttttaaaaagttcaagagccgcaaagaagaccgagagaggaaaggctccattccattccaccacacaggcaagaggaggccacggagaatgggagtgcccttcctgcttcacgaggaccacctggatgtgtcccccacgcgcagcacattctcctttggaagtttctctgggctgggagaagacaggcgaggaattgagaaaggaggctggcaaaccaccattttagggaaattgacccggcgaggcagttcagatgcagccactgagatggagagtctgagcgccaggcattcccactcccatcacaccctggtaagcgacctgccggacccctccaacagccatggagaaaacaccgtcaaggaagtgcgatctcagatctccaccatcacagttgcgaccttcaataccactttggcgtcattcaacgtaggctatgcagactttttcaatgagcatatgaggaaactctgcaaccaggtgcctatcccggagatgccacatgaacctctggcatgtgctaacctacctcgaagcctcacagactcctgcataaactacagctacctagaggacacagaacatattgacgggaccaataactttgtccacaagaatggaatgcttgatctttctgtagttctgaaggctgtttatcttgtccttaatcatgacatcagctctcgtatctgtgacgtggcgctaaacattgtggaatgcttgcttcaacttggtgtggtgccctgtgtagaaaagaatagaaagaagagtgaaaacaaggaaaatgagaccttggaaaagaggccaagtgagggagctttccaattcaaaggagtatctggaagttccacctgtggattcggaggccctgctgttagtggagctggagatggtggaggagaagaaggaggaggtggagatggaggaggtggaggaggtgatggaggaggaggtggaggaggtggaggcggcccttatgagaagaatgataagaaccaagagaaggatgaaagtacacctgtaagcaaccataggcttgctctaacaatgctcatcaaaatagtgaagtctttgggatgtgcctatggttgtggtgaaggacaccgagggctctctggagatcgtctgagacaccaggtattccgagagaatgcccagaactgcctcactaagctatacaagctagataagatgcagttccgacaaaccatgagggactatgtgaacaaggactctctcaataatgtagtggacttcttgcatgctttgctaggattttgtatggagccggtcactgacaacaaggctgggtttggaaataacttcaccacagtggacaacaaatccacagcccaaaatgtggaaggcattatcgtcagcgccatgtttaaatccctcatcacacgctgcgcttcaaccacacatgaattgcacagccctgagaatctgggactgtattgtgacattcgtcagctggtccagtttatcaaagaggctcatgggaatgtcttcaggagagtggccctcagcgctctgcttgacagtgccgagaagttagcaccagggaaaaaggtggaggagaatgaacaggaatctaagcctgcaggcagtaaaaggtcagaggcgggaagcattgtggataaaggccaggtatcctctgcacctgaggaatgtcgcagcttcatgtctggtcgcccctcacagactccagagcacgatgaacaaatgcaaggagccaacttggggcggaaagatttctggcgtaagatgttcaagtcccagagtgcagcaagtgacaccagcagccagtctgaacaggacacttcagaatgcacgactgcccactcagggaccacctctgaccgacgtgcccgctcacgatcccgcagaatttccctccgaaagaagcttaaactccccataggtaaaaggaactggctgaagagatcatccctctcaggcctggcagatggtgtggaggacctcctggacattagctctgtggaccgactctctttcatcaggcaaagctccaaggtcaaattcactagtgctgtgaagctttctgaaggtgggccaggaagtggcatggaaaatggaagagatgaagaggagaatttcttcaagcgtcttggttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctagaagcccctgtggtggccagagcagccttgttcctggaatgtgctcgttttgttcaccgctgcaaccgtggcaactggccagagtggatgaaagggcaccacgtgaacatcaccaagaaaggactttcccggggacgctctcccattgtgggcaacaagcgaaaccagaagctgcagtggaatgcagccaagctcttctaccaatggggagacgcaattggcgtccgattgaatgagctgtgccacggggaaagtgagagcccagccaacctgctgggtctcatttacgatgaagagaccaagaggagacttagaaaggaggatgaggaggaagactttttagatgacagtactgtgaacccctctaaatgcggttgcccctttgccttgaagatggcagcatgtcagcttcttctggagattaccaccttcctgcgagagaccttttcttgcctgcccagacctcgcactgagcctctggtggacttggagagctgcagacttcgtttggatcccgagttggaccggcacagatatgagaggaagatcagctttgctggggtcctggacgaaaatgaagactcaaaagattctctccacagcagcagccacactctcaaatcagatgcaggagtcgaggagaagaaagaagggagtccttggagtgcaagcgagcccagcattgagccagagggaatgagtaatgccggcgcggaggagaattaccacagaaacatgtcgtggcttcatgtgatgatcttgctgtgcaatcagcagagtttcatctgcactcacgttgactactgccatccccactgctacctgcaccacagccgctcctgtgcccgactggtcagagccatcaagctactctatggagacagtgtggactccctgagggaaagcagcaacatcagcagtgtggctctccggggcaagaaacagaaagaatgctcagataagtcatgcctgaggacaccttctctaaagaagagagtttcagatgccaatctggaaggaaaaaaagattccggaatgctgaagtacatcagacttcaggtgatgagcttgtcgcctgctcccttatctctgttaatcaaggcagcaccaattctgacagaggagatgtacggagacatccagccagctgcctgggagctcctgctcagcatggatgagcacatggcaggggcagcagctgccatgttcctgctgtgtgcagtgaaggtgcctgaggccgtgtccgacatgctgatgtcagagttccaccacccggagactgtgcagaggctgaacgctgtcctcaagttccacacgctctggaggtttcgctatcaggtctggccccggatggaggaaggggcacagcagatttttaagattccgcctcccagtatcaatttcacccttccctcgccggtgcttggaatgccatccgtcccaatgtttgacccaccgtgggttcctcagtgcagcgggagtgtccaggaccccattaatgaagaccagtctaaatccttttcagcccgggctgtgtcccgctcccatcaaagggcagaacacatcttaaagaacttgcagcaggaggaagaaaagaaacgacttggtagagaagccagcctcatcactgccatccccatcacccaggaggcttgctatgagcccacatgcacgcccaactcagaaccggaagaagaagtagaagaagtcaccaatctggcatcccgtcgactgtctgtgagtccatcctgcacctccagcacttcccacaggaattattccttccgccgcgggtcagtctggtcagtgcgttcagccgtcagtgctgaagatgaggaacataccactgaacacacgccgaaccaccatgtgcctcagcccccacaagcagtgttcccagcatgcatctgtgcagcagtacttcccattgttcatctgatggaggatggtgaggtgcgggaagatggagtagcagtgagtgctgtggctcaacaagtcttatggaactgtctaattgaagatccatcaacggttcttcgacattttctggaaaaactgaccatcagcaatagacaagatgagttaatgtacatgctgcgcaaacttctcttgaatattggagactttcctgctcagacatctcacatcctattcaactatttggtaggattaatcatgtactttgtgcggaccccctgcgagtgggggatggatgccatttcagccaccctgacattcctgtgggaggtggtgggttacgtggagggcctcttcttcaaggatctcaagcagacgatgaagaaggagcagtgtgaggtgaagctcctggtgaccgcttcaatgccaggtactaaaaccttggtagttcatggacagaatgagtgcgatatcccaacccagttaccagtccatgaagacactcaatttgaagccctgttgaaggagtgtctggagttttttaatatcccagaatcccagtcaacacattattttcttatggataaacgatggaaccttatccactacaataagacctatgttcgagatatttatcctttccggaggtcagtatctccccagctgaatcttgtacatatgcatccagagaagggacaggagctcattcagaaacaggtgttcacccgaaagctggaagaagtagggcgggtgttgtttctcatctccctaacccagaagatccccacagcccacaaacagtcccacgtctccatgcttcaggaagacctcctccgcctgccctcattccctcgtagtgctattgatgctgagttttcactcttcagtgatcctcaagctggaaaggaactgtttggcctcgacactcttcagaaaagcttgtggatccagctgctggaggaaatgttcctgggcatgccgagcgagtttccatggggagacgaaatcatgcttttcctcaacgtttttaacggggctctgatcctccacccggaagacagtgccctgctcaggcagtatgctgccaccgtcatcaacaccgcggtgcacttcaaccacctcttctctctcagcggctaccagtggattctccccaccatgctgcaggtgtactccgactatgaaagcaatccccagctgcgtcaagccatcgaatttgcctgtcaccagttctatattctacaccggaagccctttgtgctccagctgtttgctagtgtggcccctctcctggaatttcctgatgctgccaataatgggcccagcaaaggtgtgtcagctcagtgcctgtttgacttgctgcagtccctagagggagagaccaccgacatattagacatcttagagctggtcaaagctgagaagcctctcaagtcattagatttctgctatggaaacgaagatctgacattttctatcagtgaagccattaagctctgtgtcactgtggtggcgtatgctcccgaatcattcagaagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccaggcccatgacagccccacagatgagcaggtgtgaccaaggtcataagggaaccaccacagccaatcacaccatgtcgtctggggtgaacaccaggtaccaggaacaaggagccaaactgcactttatcagggaaaaccttcatttactggaggaagggcaaggcattcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagagtgaacctaatgtcctcgatgactcccagggcctggccgccgagggcagcctctctagggtggcaagtatacagagtgaacctggtcaacagaacctccttgttcagcagccgctggggaggaagaggggcctgaggcagctaagacgtcctctactatcacgtcagaaaactcagactgaacccagaaatcgccaaggggctcggctgtcaaccactcgcaggagcattcaacctaaaacgaagccgtctgcggatcagaaacgatctgtgaccttcattgaggctcagccagagccagcagctgccccaacagatgcgcttcctgcaacaggccaactacagggctgtagcccagccccttctaggaaaccagaagcaatggacgaaccagtcctcacatcttctcccgccatagttgttgcggatctccacagcgtgtctcccaagcagagtgagaacttccccactgaagaaggagaaaaggaggaggacacagaagcacaaggtgctactgcacacagtccactctctgcccaactctctgaccctgatgacttcacaggcctcgagacatccagcctcctacagcatggagacactgtccttcatatcagtgaggaaaatggcatggagaacccgctactatctagtcagttcacctttactcccactgagctggggaaaacggatgcagtattagatgagtctcatgtttaattctgtatcttgtaagctctgcaggtatagagaagacatgaaagtgatctctctactacaagttcaatacttttgcttgaaaaagattaattacaaaatagcactttacttctaatgggtggcacaaatctgaataggttttgctgccaatacacatgatgtttcataaacatcttaaaagtcaatggctaaaaggatttagttgtgtgaaaatcacaaaaccagggaggaataaggggaaagagccatttcactgcacattgtttatgattcaagaagccttcagcagttaaaaatatatactattcattgctgctttcatagaaatattaacaaatgatatgatctaaaaatagaatgcaattttttgagattactcacattatacatctcatgcaaatatttatttttatagtttaaaaaatatcaattcaggttggctatacaagtagcaatttacataaaaaaataattaataggaaaaatattactttggggagactaaataacaagcctgcagccatttttgttttgagtaacaatacagccatttagaagaagaaaaaaatactatatagagagctgtggacttttagatatttatttttcaactatcattttcattgcatgttgtaaatcaaaatgcagatggcataagatcatcccatttcataatctatcacattagaatattacagaatattctagaaatcatcagaaataattctgaattaagaacctaaacagcctatacaattataaaaactaaatgtatatataatcacttaaaagagatggtattcctattcctagccctgactacatcaataccaagattagaagctattggaaaatgtgattagtaatacttttccttatagtatcctgtgcctgccctggagggcatattttcagatattaaggttagtgttgttagaatcggtttaataaaataacattttcctaatagaaacaatattcttatgatacttggaacatctaagtttataaggaaaaatgtataaagtaagcaatttcttcatagacacctccagtttatatattttgcaaataggcctttaacttgaagttcaattacttcaagaaaagtgtaacacttagaaggcttgtgaggccaacacctagtgtgttactgatcctatggtagggctgtgcatcacgtggttcacaattgaatttcaaaattttaacagtttacattagaaaactgttacctaacaaccaagcatatacaaactcatatacatacttaaattggtacggtggtgtatgtgtgcgtgcgtgtgtgtgtgtatgtgttgtagtcctcaagatgaagttaaatatagactttaattaccctgcaatgaatttaaaacacattctgtatgcttaaactttgagtgcgttggctgtgaaatgtatacatatataaagaggatacctactaaacccaccttaatcataaaggaaaattattttttgttagaattgcttattaaataggcatactttatactgtggtttataatttcaaatataacttggggttatggtcctattcactaagagaatgaaagatatccatgagttaaaagaacaaaactaaaaatttcagatctaacaattgaaagaaaattgaggcagtaaatgacctcttttactcttttatgttttacaatattatcatgttatttacagttaatgctgaaataattctcaagtgcaggaatataaatgttaagtggttttatgattccaagctgatatatttcacctgttaaaaattatgctgctaaattagcattagaggccttatgtttggtaattacaagtgtctgggctattggcgcgtctctatatatgtgtgtgctttgttccagtttcttcaaattatctatgtataattgtatgaaatatttaaatagcaaagaagtcaaagaagattgttaaatattcaacaagaatcataaatacctttatatgtattttaaaagtattgggctgttctgaacatgattatgctggtctgtctgtcttttagcctgactccttcactcttgtgtgtgaagtctattagcaactttcaataagctaagcaatgttgtaacttgcaaaaaagcctccactctgagaaacagggccttatagagtaggaatgttttcatactgggactactgaaattttgcagatgtgtgcatctgttccatttaaggtgcccttaaatgtgttgaatgtaatgtgttgaatgtttatgtgtaatggctaaagtatctatatgtatgtgcataaaactgtcacaagatgtattctcaggaatactgttacctggagtttgaaaggaataactattaaaaaaaaaagttggggaagattagaaaaaagctcaagataaatgttcaaaatattattaagtacatgactaaaagctaattactacatatgataaatgcagtgttggtaatagtagatcatttcttaagccatgatacttaatgatatttatcttattcagaggaaaaacaaaaaaggtacccacttcccatgtagaaaaaattagactcagcaaagaggttgcttcttctgaaattagcttttgagagaccttggaataaaccatgtgttatccatgatagtatgactcagatccaattaaaacagtttaaattctggatataggatctcctatagcaaaacattttactttcatttttcagtatttgctgctttctagaattctattagataagctatgtcatttttctgaaaaagaaactgagttattgagtgtattaagacaaggcactgagaactacagtgtcaaaatcaaagggcataaatgggcatggcagtgctggtggaaaaatctgtggtactggtgatctggttagggcctgttgcacaggctgggagtaactggtttgctgtttcaagcctccaagagtaccttaaacaaggtgatagctcctctcttctttagcattatattcctttagtcaacaaagaactttctccactctgctgcccagctctgagagtatctgagatgagaataggatgtgtgtggaggggcttttagggaagaaagggtcataaatgaatagaagtacagtctgaaacatgaattaaatatccttcctcaagttataaaggatactttaatagaacacagtctccagaattcgctgctatcacaccaagtcatgctgttgccctgtgacctcacacttcccattccatggccttgtcttggcagggagtaaaaaatcccacttctttttactttagtgggtctcaactgcagcatttcagaaacaaattttgatttgacactcaggagaataaaaacaagttgagggcagaatgtatttggaaaagcttaagacaaatttactgatattattttatgatcatttaggattacagatcaatttacctccataaatctttgaattgtcactgtgaccacaggatgaaaatcctttattagccattttataggttaaaacaaaaaattgactacacagccgacttccctcagataactatgaagtctattatgagtactgaatgaccaaagaacatggaaaaaatgcatatgaataaatactgaaatgtttatgaaagatatttatgaaagatattaagacttctgtgtttaggtatgcacatatgataaaataaatctaaaaacattaaagatg

SEQ ID NO: 33845 - DNA, 2033 bp, Homo sapiens
actaatgctaatgagaatggttcaaatactatgttaaacactggggatgtaaactaaggtcctggtcttcaagattatcacggttcaatgcaagaggcacataagaaaataactatgatacaaagttgttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggcgacaggttgagtgggagcctgccagcaatttgattgaaggggtttgtttgacacttcagaggcagccaatcatatccttcctgcctcaccttaggtcactgatcaatgtctgtgtcaatctggtgatgggagtggtaggaccttccagtgttgctgatggattaccccttcttcatctcagcccttatctctcaccacctctgcccttcagcacagctgttgtccggcttgtagcattgcagatacaggctttaaaagaagattttcctttaagccatgtgatctccccattcaccaatcaagagcgaagggaggggatgcttttaaatctgctcatcccatttgtgctcacagtaggatctggaagcaaagatagcccatggctggagcagcctgaggtgcagctgctgctgcagacagtcatcaatgtactcctcccaccgcggatcatcagcacatccaggagcaagaacttcatgttagagagctccccagcccactgctccacccctggggatgcggggaaagacttgcgcagggaagggctggctgagtccaccagccaagcagcatacttggcgctgaaggtgattctcgtctgctttgagaggcagctcggaagccagtggtactggctgagcctccaggtgaaggagatggctctgcggaaggtgggaggcctggccctttgggatttcctcgacttcatcgtgcggacccgaatacccatctttgtgcttttgcgccctttcatccagtgcaagctgctggcccaaccagcagagaatcatgaagagctttccgcccggcaacatattgccgaccagctggagcggcgcttcataccacgccctttgtgtaagagctcgctcattgctgagttcaacagtgaactaaaaattctaaaagaggcagttcatagtggatcagcctaccaaggcaagacatccatcagtaccgtgggcacctccacctctgcttaccgcctgagcttggccaccatgtcccgctctaacacgggcacgggcactgtctgggagcaggacagtgagccatcccagcaggcttcgcaggacaccctgagtcggactgatgaggaagatgaggaaaatgactctataagcatgcccagcgtggtaagtgaacaagaagcttacctcctgagtgccattggaaggaggcgattctccagccatgtctccagcatgtctgtacctcaggctgaggtgggcatgctacccagccagaggtaaacagctatggttatactgtactctgcatttgggggcaaagttagaaattctgaaaatacactcctgttattctacaaagacagaaagagaagcaagcaatggtaatgtttttagatagatcattccacaaaggatttgtcaactaggttcctgcaggcaacactttgcagttttctaagccaagctagtagaagggatcccaatttccaagtattgtctctccttaaaaattttccatagacacatggtcttctttctgttgtcaaatggcattcttgtatttcagatttatcattagctaagctaatgatgggtacttggcaagagtttggaccatctttatgtttttggtaaagtttaggcttctgatatattattagtattcagttgtaggtagtgacacttaaccaagcagaaaaggatctatgccactgagtgtgaccttgggca

SEQ ID NO: 33846 - DNA, 2116 bp, Homo sapiens
attaacgagtgacagtcttaatgactaacacacctctaacatttcacctctagctcagatgagagagagaatgggacttcttggtactgattgtttttcccatgcctcaattggtttcttttagggagctacaaatttacgtgttcactggtgattgatcttttcatccagcacaatggacagaagtctaaggaacgtccttgtggtttcctttgggttcctgcttctctttacagcctatggaggtctgcagagcctgcagagcagcctgtacagcgaggagggcctgggtgtcacagcgctcagcaccctctatggaggcatgctcctgtcctccatgttcctcccaccgctcctcatcgagaggctgggctgcaaggggaccatcatcctctccatgtgtggctacgtggccttctccgtgggcaacttcttcgccagctggtacactttgatccccacctccatactgctgggactcggggccgccccgctgtggtctgcacagtgcacatacctcacgatcacgggaaacacacatgcagagaaggcgggaaagcgtggcaaagacatggtgaaccagtattttggcatcttcttcctcatattccagtcatccggtgtgtggggcaacttgatctcatcgctggtatttggccagactcccagccaagagacccttccagaagagcagctcacgtcctgtggggccagtgactgcctgatggccaccacaaccaccaacagcacccagaggccctcccagcagctggtctacaccctcctgggcatctacactgggagtggtgtcctggctgtcctgatgatagctgcgttcctccaacccatacgagatgttcagcgggaaagtgaaggagagaagaaatcagtacctttctggtccactttactgtcgactttcaagctatatagagataaacgtctgtgcctcttaattctgctgccgctgtacagtggattgcagcaaggattcctctccagcgaatacacaaggtcctatgtcacctgcaccctgggcatccagttcgtcggctacgtgatgatctgcttctcggccactgacgcgctgtgctccgtgttgtatggaaaggtctcgcagtacacgggcagggctgtgctgtacgtgctgggcgcggtgacccacgtgtcctgcatgattgccctactgctgtggagacctcgtgctgaccatctggcagtgttcttcgtattctctggcctgtggggcgtggcagatgccgtctggcagacacaaaacaatgctctctacggcgttctgtttgagaagagcaaggaagctgccttcgccaattaccgcctgtgggaggccctgggcttcgtcattgccttcgggtacagcatgtttttgtgcgtgcacgtcaagctctacattctgctgggggtcctgagcctgaccatggtggcgtatgggcttgtggagtgcgtggagtccaagaacccgatcagaccccacgctccaggacaggtcaaccaggcagaggatgaagaaatacaaacaaaaatgtgagagcagtgaggtccgaggaggatgaactcagaaagcaccagccagagaattttcttagaagatgcctcaggacatagagcggctcctcatcaccatctcagcacaatttggccattctgaagagatcatgttatttcactcttcatgtattttttttctattctaacaaatttttcgtccaccatcttaacagagatcaagtgtatacatgaaggtatcagttcatttaattttagatgcaaaagaaaaaggtctaacgtacaatcagccaattagaatttgcctgaaatcatagactcaccctagttttattgctgtagttgtttttaagaattggaagcctgcttaaaaaatgtagttgagccccataattttacaaatgggcgaacttttaaacttctaactctacttggatcaaaacctcatacattttacaaaggggtcctgacaagtcagctgactcaacctcacagagtcagggggtgacaaagccagactggggctcaggattcctgaaacgtgtggggtctgcgtttctaaataaagacggttatttaatggacttac

SEQ ID NO: 33847 - DNA, 1810 bp, Homo sapiens
ggtgattgatcttttcatccagcacaatggacagaagtctaaggaacgtccttgtggtttcctttgggttcctgcttctctttacagcctatggaggtctgcagagcctgcagagcagcctgtacagcgaggagggcctgggtgtcacagcgctcagcaccctctatggaggcatgctcctgtcctccatgttcctcccaccgctcctcatcgagaggctgggctgcaaggggaccatcatcctctccatgtgtggctacgtggccttctccgtgggcaacttcttcgccagctggtacactttgatccccacctccatactgctgggactcggggccgccccgctgtggtctgcacagtgcacatacctcacgatcacgggaaacacacatgcagagaaggcgggaaagcgtggcaaagacatggtgaaccagtattttggcatcttcttcctcatattccagtcatccggtgtgtggggcaacttgatctcatcgctggtatttggccagactcccagccaagggagtggtgtcctggctgtcctgatgatagctgcgttcctccaacccatacgagatgttcagcgggaaagtgaaggagagaagaaatcagtacctttctggtccactttactgtcgactttcaagctatatagagataaacgtctgtgcctcttaattctgctgccgctgtacagtggattgcagcaaggattcctctccagcgaatacacaaggtcctatgtcacctgcaccctgggcatccagttcgtcggctacgtgatgatctgcttctcggccactgacgcgctgtgctccgtgttgtatggaaaggtctcgcagtacacgggcagggctgtgctgtacgtgctgggcgcggtgacccacgtgtcctgcatgattgccctactgctgtggagacctcgtgctgaccatctggcagtgttcttcgtattctctggcctgtggggcgtggcagatgccgtctggcagacacaaaacaatgctctctacggcgttctgtttgagaagagcaaggaagctgccttcgccaattaccgcctgtgggaggccctgggcttcgtcattgccttcgggtacagcatgtttttgtgcgtgcacgtcaagctctacattctgctgggggtcctgagcctgaccatggtggcgtatgggcttgtggagtgcgtggagtccaagaacccgatcagaccccacgctccaggacaggtcaaccaggcagaggatgaagaaatacaaacaaaaatgtgagagcagtgaggtccgaggaggatgaactcagaaagcaccagccagagaattttcttagaagatgcctcaggacatagagcggctcctcatcaccatctcagcacaatttggccattctgaagagatcatgttatttcactcttcatgtattttttttctattctaacaaatttttcgtccaccatcttaacagagatcaagtgtatacatgaaggtatcagttcatttaattttagatgcaaaagaaaaaggtctaacgtacaatcagccaattagaatttgcctgaaatcatagactcaccctagttttattgctgtagttgtttttaagaattggaagcctgcttaaaaaatgtagttgagccccataattttacaaatgggcgaacttttaaacttctaactctacttggatcaaaacctcatacattttacaaaggggtcctgacaagtcagctgactcaacctcacagagtcagggggtgacaaagccagactggggctcaggattcctgaaacgtgtggggtctgcgttt

SEQ ID NO: 33848 - DNA, 775 bp, Homo sapiens
gagggccagagttaagacagagcttaagacagagaacctcaacaggaggcctgaaggaaagcacctgggagtcattaggcagcaagggagggaattgcaattctgggcggggctcagctgtgcagagtttagcaaggtctccaggtgcttctgctgagggccagagttaagaaagagcgagaacctcatcaggaggactgaaggaaaggagccaggctgcagccctctgcctgcccttccgtgccatcatctccaggattaatgaaagggccattcaggaaacagcacagggagctacaaatttacgtgttcactggtgattgatcttttcatccagcacaatggacagaagtctaaggaacgtccttgtggtttcctttgggttcctgcttctctttacagcctatggaggtctgcagagcctgcagagcagcctgtacagcgaggagggcctgggtgtcacagcgctcagcaccctctatggaggcatgctcctgtcctccatgttcctcccaccgctcctcatcgagaggctgggctgcaaggggaccatcatcctctccatgtgtggctacgtggccttctccgtgggcaacttcttcgccagctggtacactttgatccccacctccatactgctgggactcggggccgccccgctgtggtctgcacagtgcacatacctcacgatcacgggaaacacacatgcagagaaggcgggaaagcgtggcaaagacatggtgaaccagtattttggcatcttcttcctcatatt

SEQ ID NO: 33849 - DNA, 2313 bp, Homo sapiens
gtcccggccgccgggaggaagtggccgggcggtcgcagggactccggggcgaccgccgcgagtccgcagtagttcgggccatggaggcggagccgccgctctacccgatggcgggggctgcggggccgcagggcgacgaggacctgctcggggtcccggacgggcccgaggccccgctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtgttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtc

SEQ ID NO: 33850 - DNA, 1462 bp, Homo sapiens
agagcaagggaaaggaacttcctccaccttcggggctggagcccttttcctctgcatctccagtctctgagtgaagatggggggcctgacagcctcggacgtacacccgaccctgggggtccagctcttctcagctggaatagcggcgtgcttggcggacgtgatcaccttcccgctggacacggccaaagtccggctccaggtccaaggtgaatgcccgacgtccagtgttattaggtataaaggtgtcctgggaacaatcaccgctgtggtaaaaacagaagggcggatgaaactctacagcgggctgcctgcggggcttcagcggcaaatcagctccgcctctctcaggatcggcctctacgacacggtccaggagttcctcaccgcagggaaagaaacagcacctagtttaggaagcaagattttagctggtctaacgactggaggagtggcagtattcattgggcaacccacagaggtcgtgaaagtcagacttcaagcacagagccatctccacggaatcaaacctcgctacacggggacttataatgcgtacagaataatagcaacaaccgaaggcttgacgggtctttggaaagggactactcccaatctgatgagaagtgtcatcatcaattgtacagagctagtaacatatgatctaatgaaggaggcctttgtgaaaaacaacatattagcagatgacgtcccctgccacttggtgtcggctcttatcgctggattttgcgcaacagctatgtcctccccggtggatgtagtaaaaaccagatttattaattctccaccaggacagtacaaaagtgtgcccaactgtgcaatgaaagtgttcactaacgaaggaccaacggctttcttcaaggggttggtaccttccttcttgcgacttggatcctggaacgtcattatgtttgtgtgctttgaacaactgaaacgagaactgtcaaagtcaaggcagactatggactgtgccacataatcagcttcaagaaaatgatgtaacataccagtgggaatcttgctgactggatcataaaaacaaacaaaacttattcacttattttaacctaaaaagataaaggaattttggcagagaattttggacttttttatataaaaaagaggaaaattaatgcctatttcatataactttttttttttctcagtgtcttaagaaggggaaagcaaaacattcagcatataccctggcaaatgtaatgcagataagctactgcatttgaccatttctggagtgcaattgtgtgaatgaatgtgaagaactttaacatgttttaattacaattccaactggtggaaaagaaactgagtgaaatgcagtttatatttataaatacttaaaaatgaagttattaaaaatattagtttttattaaccacagttgtcagttaatatattcaataaagtattgctaatacctttt

SEQ ID NO: 33851 - DNA, 2113 bp, Homo sapiens
agccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttggcgtc

SEQ ID NO: 33852 - DNA, 464 bp, Homo sapiens
gggcagcagctgggtcttattcttctctggccttcacaacatcctgcaacccagctcaaggtcaggaatgtgacagactcatgtcatcatatctctgatgcccagagaagggataccatttgcctgagccttctcagtactgtttaatcagcctgtgagaactttccttgtgaaaggccctgtctgtgcctggggctgataaaacagcaagaacgaactgaggagctgggcagcagtgcaaagcaaatactaccagctttggtgcctattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcc

SEQ ID NO: 33853 - DNA, 2623 bp, Homo sapiens
atatttagcacatagtaggcacaaagaaatgacattattattaagagacctgggagagctgtgcccagcctatcgtgggaggccttgacctttggactcaaaagtggcagcaggtccacccccccatacacccttgtcaccaaggaagcgtccacagcttaaaggagctatattaaagcaccccaagtcaagaggactgaaccagatctggaactcactcacctcccctctcacctcactgccctcaccagccagcctcttgtcaagtgatcaggctgtcaaccaacttctctaggataaggtttcaggtcagcccgtgtgtataagaccagtgccaagccagaagcagcagagacaacagtgaatgacaaggaggggccatccaatccctgctgccacctcctgggatggagccctagggagcccctgtgctgcccctgccgtggcaggactcacagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacaactccagcctcactacccggattttggccggctgcaccacaggagccatggcggtgacctgtgcccagcccacagatgtggtgaaggtccgatttcaggccagcatacacctcgggccatccaggagcgacagaaaatacagcgggactatggacgcctacagaaccatcgccagggaggaaggagtcaggggcctgtggaaaggaactttgcccaacatcatgaggaatgctatcgtcaactgtgctgaggtggtgacctacgacatcctcaaggagaagctgctggactaccacctgctcactgacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaagggatttacaccctcctttttgcgtttgggatcctggaacgtggtgatgttcgtaacctatgagcagctgaaacgggccctgatgaaagtccagatgttacgggaatcaccgttttgaacaagacaagaaggccactggtagctaacgtgtccgaaaccagttaagaatggaagaaaacggtgcatccacgcacacatggacacagacccacacatgtttacagaactgttgtttacttgttgctgattcaagaaacagaagtagaagaggaggagggattctggtcttcactgccatgcctcaagaacacctttgttttgcactgacaagatggaaaataaattatattaatttttgaaacccattaggcatgcctaatatttaggcaagagaaaataaaccaagatagatccatttggacaaaatggaaggttggagacgtgtatccccgtgaaatctggttagataatgaatgataagcaggaaggatggcaagcacgggacaggaggggcccacaatggagtgggagatcagccacggagcctggagggatgccacccagcaacacagagctggcgactgcagctgcaccatcacacatgcatcatcagcctatttgtaatatgtctgccacagagagtcctttgggattctaggaaacccaaggaacaagagaaaaaactagagcctgtgctaaagaagccctgctgggcccatgtgaggctggggctcgtaaatattccctgacgacactgaagaatcaagagggcagcccccactttcctacaaaatggagggagccatcccttccctgtccacctcaccaggggtgctatgacatgcaagtgagaagctgggcatgaacgcactttataaaagcaaaagctctgtgtaaatctaactacaaggacaatgccttgggagagattttgtcgggacagagaggagttgccagggaagaaggtttgaaagatacggttgtctagaggtgagaccaaaggatccagagacttggggaccagaggtgacagtggatgacgtgaagccacaggagccccacccccatgcagcctcttccccaccccccccaccacgtgctcaatcatgagtacctcaaaggattgttgggcttgggggaaaagaggtggattcctgggcaagaacctaaagtagcaggactcggaattctcgggaaattattatgactcaataaaagaattcacaccttaggtgtgggagtaagaaca

SEQ ID NO: 33854 - DNA, 2112 bp, Homo sapiens
gaaccagatctggaactcactcacctcccctctcacctcactgccctcaccagccagcctcttgtcaagtgatcaggctgtcaaccaacttctctaggataaggtttcaggtcagcccgtgtgtataagaccagtgccaagccagaagcagcagagacaacagtgaatgacaaggaggggccatccaatccctgctgccacctcctgggatggagccctagggagcccctgtgctgcccctgccgtggcaggactcacagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacaacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaagggatttacaccctcctttttgcgtttgggatcctggaacgtggtgatgttcgtaacctatgagcagctgaaacgggccctgatgaaagtccagatgttacgggaatcaccgttttgaacaagacaagaaggccactggtagctaacgtgtccgaaaccagttaagaatggaagaaaacggtgcatccacgcacacatggacacagacccacacatgtttacagaactgttgtttacttgttgctgattcaagaaacagaagtagaagaggaggagggattctggtcttcactgccatgcctcaagaacacctttgttttgcactgacaagatggaaaataaattatattaatttttgaaacccattaggcatgcctaatatttaggcaagagaaaataaaccaagatagatccatttggacaaaatggaaggttggagacgtgtatccccgtgaaatctggttagataatgaatgataagcaggaaggatggcaagcacgggacaggaggggcccacaatggagtgggagatcagccacggagcctggagggatgccacccagcaacacagagctggcgactgcagctgcaccatcacacatgcatcatcagcctatttgtaatatgtctgccacagagagtcctttgggattctaggaaacccaaggaacaagagaaaaaactagagcctgtgctaaagaagccctgctgggcccatgtgaggctggggctcgtaaatattccctgacgacactgaagaatcaagagggcagcccccactttcctacaaaatggagggagccatcccttccctgtccacctcaccaggggtgctatgacatgcaagtgagaagctgggcatgaacgcactttataaaagcaaaagctctgtgtaaatctaactacaaggacaatgccttgggagagattttgtcgggacagagaggagttgccagggaagaaggtttgaaagatacggttgtctagaggtgagaccaaaggatccagagacttggggaccagaggtgacagtggatgacgtgaagccacaggagccccacccccatgcagcctcttccccaccccccccaccacgtgctcaatcatgagtacctcaaaggattgttgggcttgggggaaaagaggtggattcctgggcaagaacctaaagtagcaggactcggaattctcgggaaattattatgactcaataaaagaattcacaccttaggtgtgggagt

SEQ ID NO: 33855 - DNA, 1406 bp, Homo sapiens
agagacaacagtgaatgacaaggaggggccatccaatccctgctgccacctcctgggatggagccctagggagcccctgtgctgcccctgccgtggcaggactcacagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcggcctctatgactccgtcaagcaggtgtacacccccaaaggcgcggacaactccagcctcactacccggattttggccggctgcaccacaggagccatggcggtgacctgtgcccagcccacagatgtggtgaaggtccgatttcaggccagcatacacctcgggccatccaggagcgacagaaaatacagcgggactatggacgcctacagaaccatcgccagggaggaaggagtcaggggcctgtggaaaggaactttgcccaacatcatgaggaatgctatcgtcaactgtgctgaggtggtgacctacgacatcctcaaggagaagctgctggactaccacctgctcactgacaacttcccctgccactttgtctctgcctttggagccggcttctgtgccacagtggtggcctccccggtggacgtggtgaagacccggtatatgaactcacctccaggccagtacttcagccccctcgactgtatgataaagatggtggcccaggagggccccacagccttctacaaggggtgagcctcctcctgcctccagcactccctcccagagaacaggggcttctttcttttcgaatgtggctaccgtgggtcaacctgggatgtagcggtgaagagtacagatgtaaatgccacaaagaagaagtttaaaaaaccatgcaagtaaaagaaaaaaagtgaaccatacctgatggggagggttagggaagcctgactgagaacaaacactccaggaataggtaaaagtactgcctgtctccagaggaagttagcaatcctgagacctcctggacctcctgccatggccattgagcaccacactgaccatggccagtgccttcctcactgtctccacacgctccacgttttcttgcacttactgctccctctgcgt

SEQ ID NO: 33856 - DNA, 551 bp, Homo sapiens
attcaagggataggaacgtgacctgtttttataggccaaattcatgcagcttaagtatggcaccacccaggcttctccctttctaaagcccctcctgggtaaggaagagttcctgggagccaggccagacatcactccatcagccttctctggcctgtctcctgcagccccaccgctgcactgaagcccagggctgtggagcagcctctctccttggacctcctctcggccctaaagggactgggcagagccttccaggactatggttggactgaagccttcagacgtgcctcccaccatggctgtgaagttcctgggggcaggcacagcagcctgttttgctgacctcgttacctttccactggacacagccaaggtccgcctgcagatccagggggagaaccaggcggtccagacggcccggctcgtgcagtaccgtggcgtgctgggcaccatcctgaccatggtgcggactgagggtccctgcagcccctacaatgggctggtggccggcctgcagcgccagatgagcttcgcctccatccgcatcg

SEQ ID NO: 33857 - DNA, 1157 bp, Homo sapiens
cgccccagccccgggatgctgctccggccccgcaggccgcccccgctcgcgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccagacgccaccccgctgcccaccgcccgcgaccgcgacgcggaccccacctggacgctccgcttcagcccgtccccaccgaagtctgcggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagaccctggggcacctgggcgacatcgcgaacatcctgggcccgctgcgcgaccagctgctgaccttgaaccagcacgtggagcagctgcgcggcgccttcgaccagacagtgtccctggccgtgggcttcattctgggcagcgcggccgccgagcgaggggtcctcagggacccgtgccagtgagtcccggctgcggccagtctcccctctccaggccgaggcccctccgccctgacccctcctgctgccttcccacccccgttcttgggtatgttcaataaaaggattgttttcctaga

SEQ ID NO: 33858 - DNA, 5344 bp, Homo sapiens
cacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgcgcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctgtaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttc

SEQ ID NO: 33859 - DNA, 1740 bp, Homo sapiens
atgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcggaaaaggccttttgtaatggaaatctcgcgagggttaatcttctcttgagaatggcagtcaagaaatga

SEQ ID NO: 33860 - DNA, 5569 bp, Homo sapiens
gctgaaatactgacattgaatattatatgaaatagtgaactgccatctttcatggttgtcaaatgctagggttaaagctgactcaaaatgttcacagatatattctgaagtatttacaattaaatgacatattgttttggagttgatagtggctgaatctgagtgatgggtacgtggaggttccttatattatgctctctacttttgtctgggcttggatttttccttataaaaagtaaaaaacaagtacttagacataggcctaactaataatgataggatgtggaatgtgatgaataacttattttgtaacagaaatagtattcattttacctgcctttatttactcttttacaattgccaagttgcattaatatgttctgtttaaaaaaatagtgtgatatcattttaaaaagtcactgcatctatggtactgacattctttccctcttacagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 33861 - DNA, 5193 bp, Homo sapiens
gtggggggaggggaggggagagcccgagcgctggagttggtgctgggaaacccggggctaatgttgacaacaggctcgagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 33862 - DNA, 1935 bp, Homo sapiens
cccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaaagaagagaggatgagaatgaaaaagctcacactagatatcaatga

SEQ ID NO: 33863 - DNA, 2840 bp, Homo sapiens
gtggggggaggggaggggagagcccgagcgctggagttggtgctgggaaacccggggctaatgttgacaacaggctcgagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattta

SEQ ID NO: 33864 - DNA, 5223 bp, Homo sapiens
gcatgccgcagggaagacgatcaggactgtttttaatcgggcagtcgcgcggatggccttttccctctcgcctccttccgccccgcccccactctcagcccggccgcgctgattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactggaagatgataagagaaaaaaggaagacaaggaacgcaagaaaaaagacgaagaaaaggtgaaggcagaggaagaatcaaagaaaaaagaagaggaagaaaaaaagaaacatcaagaggaagagagaaagaagcaagaagagcaggccaaacgtcagcaagaagaagaagcagctgctcagatgaaagaaaaagaagaatccattcagcttcatcaggaagcttgggaacgacatcatttaagaaaggaacttcgtagcaaaaaccaaaatgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgctgtgcacctctgctctctctttcaccagcgttatgctgactttgccccatcacttcttcaggtctggaaaaaacattttgaagcaaggaaagaggagaaaacacctaacatcaccaagttaagaactgatttgcgttttattgcagaattgacaatagttgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggcgcattctacattctaaaggggagctcagtgaagatagacataaacagtatgaggaatttgctatgtcttaccagaagctgctggcaaattctcaatccttagcagaccttttggatgaaaatatgccagatcttcctcaagacaaaccaacaccagaagaacatgggcctggaattgatatattcacacctggtaaacctggagaatatgacttggaaggtggtatatgggaagatgaagatgctcggaatttttatgagaacctcattgatttgaaggcttttgtcccagccatcttgtttaaagacaatgaaaaaagttgtcagaataaagagtccaacaaagatgataccaaagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaagaacaagaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggttggatttgctaccattttatgcaagattggttgctacattgcatccctgcatgtctgatgtagcagaggatctttgttccatgctgaggggggatttcagatttcatgtacggaaaaaggaccagatcaatattgaaacaaagaataaaactgttcgttttataggagaactaactaagtttaagatgttcaccaaaaatgacacactgcattgtttaaagatgcttctgtcagacttctctcatcaccatattgaaatggcatgcaccctgctggagacatgtggacggtttcttttcagatctccagaatctcacctgaggaccagtgtacttttggagcaaatgatgagaaagaagcaagcaatgcatcttgatgcgagatacgtcacaatggtagagaatgcatattactactgcaacccacctccagctgaaaaaaccgtgaaaaagaaacgtcctcctctccaggaatatgtccggaaacttttgtacaaggatctctctaaggttaccaccgagaaggttttgagacagatgcgaaagctgccctggcaggaccaagaagtgaaagactatgttatttgttgtatgataaacatctggaatgtgaaatataatagtattcattgtgtagccaacctcttagcaggactagtgctctaccaagaggatgttgggatccacgttgtggatggagtgttagaagatattcgattaggaatggaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggcctagtaaatgacaaagactcaaaagattctatgacagaaggagaaaatcttgaagaggatgaagaagaagaagaaggtggggctgaaacagaagaacaatctggaaatgaaagtgaagtaaatgagccagaagaagaggagggttctgataatgatgatgatgagggagaagaagaggaggaagagaatacagattaccttacagattccaataaggaaaatgaaaccgatgaagagaatactgaggtaatgattaaaggcggtggacttaagcatgtaccttgtgtagaagatgaggacttcattcaagctctggataaaatgatgctagaaaatctacagcaacgaagtggtgaatctgttaaagtgcaccaactagatgttgccattcctttgcatctcaaaagccagctgaggaaagggcccccactgggaggtggggaaggagaggctgagtctgcagacacaatgccgtttgtcatgttaacaagaaaaggcaataaacagcagtttaagatccttaatgtacccatgtcctctcaacttgctgcaaatcactggaaccagcaacaggcagaacaagaagagaggatgagaatgaaaaagctcacactagatatcaatgaacggcaagaacaagaagattatcaagaaatgttgcagtctcttgcacagcgcccagctccagcaaacaccaatcgtgagaggcggcctcgctaccaacatccgaagggagcacctaatgcagatctaatctttaagactggtgggaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaattt

SEQ ID NO: 33865 - DNA, 2235 bp, Homo sapiens
ggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 33866 - DNA, 2378 bp, Homo sapiens
agctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 33867 - DNA, 1464 bp, Homo sapiens
ggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagcc

SEQ ID NO: 33868 - DNA, 2378 bp, Homo sapiens
gcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaaggtacacaggtttctgttacaagctgtgaatcagaaaaatctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtgtgaa

SEQ ID NO: 33869 - DNA, 2335 bp, Homo sapiens
gcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaagctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtg

SEQ ID NO: 33870 - DNA, 1388 bp, Homo sapiens
gtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgc

SEQ ID NO: 33871 - DNA, 3805 bp, Homo sapiens
gtcgccgcgtgccgagcgtcctggcgcggccgaggggaagcagcggggctgcccgggttacgctggccacccgcacctggtcctgtggcttcgaccactagtcagcaaggccccggagaggccagcgaagaggaggggctcgttggctttacggagacgcgcggagcaccctcaaggtgccacacgctcgcctgctccctgttcctacatcctgggcgtcttcccaggctgtcatataactcctgagaatagtggttcttaactctgtaagtatatatacttgtttcaggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcatgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaatgagtgc

SEQ ID NO: 33872 - DNA, 5658 bp, Homo sapiens
ataattttcaaacatatgacaggaaagcatttttatgatactttcttgtattttacatgtgtcttatttttggaatcagaaaaacatatatggtgatattagtaattttcaaaaactgcactgcagagagctcccttgcccctgagtagggccgttggaagtgctgttctctgccgtcttggtccgactccgcctgatacacagacaggaaacttagcaaggcttagaagtgggctggagcccgagttgacagattggctggtgttataatttttaaaattactggctatagggtacagtggctcattattttttgttgagatgaggttttgccatgttgcccaggctagtcttgaactcctgggctcaagtgatccccttgctttggcctcccagatgctggaattacaggcatgagtcactgcaccctgctctaaaatgatactattctgactgcagcatccccctccacatttcatgttctgatgtgagcaagagagccttctctttctgcccatgtatttattatccatgtggactcactaattgctggttttcaatggttttaaatcagttactgtgtttatgtttgtgctcacattgtcctagatttgaccagtgagagttcctcaggctggctcctgtgcccatcatgttttcgagcatttccttactttctgaaataagatgctcaggctcctcctgttctttccttgccccagccatcattcaggatctccaaggagtccgtttcttttagcgtggaaggtattaaagggtgctaggcatgcccattgccacaacagtgtctttgcttcttggccctttccgtggacagttaggaaatagatgcatgtgtacactcgtatacacacagagatatgtgtgcacacctacatctacacacttaaacacatatgcacataagcatgcatatagaaatcacagttcacacgagtgcctccagttccattgcgcctctgcaagttctgctgtaactctccattctatgtttgtatgtcctttcttcagcagttagttagcaccctggctcctggcagaatcaatacatttactcatttgctcactctatgatacatctaaaatagtttagtctttttttttttttttttgagatggagttttgttcttgtcacccaggctggagtgcagtggtgcgatctcggctcactgcaactctgcctcctgtgttcaagtgattctcctgccttagcctccgaagtagctgggattacaggcgcctgccaccacgcctggctaatttttatatttttagtagagacagggtttcaccatgttggccaggccagtctcgaactcctgacctcaagtaatccgcccgcctcagccttccaaagtgctggaattgcaggcgtgagccaccacaccaggcctaaaatagtttattcttaattagactgcacttatcatagctatttaaaataattcaggatcaccccttccagaccacagtgttaacttcagatgaacatccttctagagttctgtatatatacctatagataaacatacacaattttattaaattgtaatcatactgtgcatacttttctgtagcctgactttcccccgactaattaatataacagctttccctaatatctcatccagcatctttttgtccacaaaagaaatccatagcgtattttttaatggctgcagaatttgaccataattccgttattgcactttgattttaaaaggcatcagtttttcgctattatatataaagctggcatcaacatctttgtaactaaatcttaattatttccttaggatagaagtggaattactgggcaaagggtatgtatatttttctgtctttctgaatgactgtatttgtgctctggccagcagttttggagagtgctggttttctagaccagtgtttctcaactgtgggtgcatatcagaatcattgagggcacttttaaaagcagtgatacccaggaccagctcccagagattctggtttcatggatctggggtgtgacccagggtttatagtttttaaaagctctccaagagattttatatgcggccagtttgataggtgaaagtggtattccatttttttaattataattttcttctgaaattgtttcaggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcatgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaa

SEQ ID NO: 33873 - DNA, 3563 bp, Homo sapiens
aggaagcgaaggaggcgggagcggagacctcgctgcgctcatggcgtcgcccgggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcatgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaa

SEQ ID NO: 33874 - DNA, 885 bp, Homo sapiens
actgtggggccgtcgtcgccgcgtgccgagcgtcctggcgcggccgaggggaagcagcggggctgcccgggttacgctggccacccgcacctggtcctgtggcttcgaccactagtcagcaaggccccggagaggccagcgaagaggaggggctcgttggctttacggagacgcgcggagcaccctcaaggtgccacacgctcgcctgctccctgttcctacatcctgggcgtcttcccaggctgtcatataactcctgagaatagtggttcttaactctgatagaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatgg

SEQ ID NO: 33875 - DNA, 3596 bp, Homo sapiens
cggccgcgcggaggaagcgaaggaggcgggagcggagacctcgctgcgctcatggcgtcgcccggaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcatgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatgaa

SEQ ID NO: 33876 - DNA, 3408 bp, Homo sapiens
actgtggggccgtcgtcgccgcgtgccgagcgtcctggcgcggccgaggggaagcagcggggctgcccgggttacgctggccacccgcacctggtcctgtggcttcgaccactagtcagcaaggccccggagaggccagcgaagaggaggggctcgttggctttacggagacgcgcggagcaccctcaaggtgccacacgctcgcctgctccctgttcctacatcctgggcgtcttcccaggctgtcatataactcctgagaatagtggttcttaactctaaagagtcttgctgtgtcacccaggctggagtgcagtggtgaaatcttggctcactgtggcttcagcctcccaggctcaagagatcctaccatctcagcctcctgagtagctgggactacaggatagaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcatgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccag

SEQ ID NO: 33877 - DNA, 4042 bp, Homo sapiens
attttacaatgggtaccgtctcagagaggccagcaactcgtccaacacagcactgcaagtaagaagtaggaaagttattgttttgcttaataataaggccttacgcttcagggctaaagaaaagccttttcttacagaaattaaactccaattacagaaaggtgtgaagttcagtaaggccctggggcaggttatcctacagcttttggcaccgcaggcaccgcccggcgagttccggcctccaggcacctgggcaggtgggcgttgggcgggctgcgggctgacctgggccgccccgcccccaccccgccccagctgtccccgggctgctccgagaggaccccgggcccaccttaccccacctcaccccacctccacccctggagcgcgtcccggagcgggcgggcggccggcgggccaggcccctccccggcgccgagccgcggccgcgcggaggaagcgaaggaggcgggagcggagacctcgctgcgctcatggcgtcgcccgggatagaagtggaattactgggcaaagggcattcagatttgggagaagtagccccagaaataaaagcatcagagagacgaacagctgtggccattgcagatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctgccgacatttattccttttctgagctgcccacccctgatacgccagtgaaccccttagaccttctctgtgccctgctgctctcctcagacagtttcctgcaacaagaaatagcgttgaaaatggccctctgccagtttgcactcccactcgtgttgcctgactcggagaaccactaccatacatttctgctgtgggccatgcggggcattgtgaggacatggtggtcccagcccccaaggggcatggggagcttccgggaagacagcgtggtcttgtccagggcgcccgccttcgccttcgtgcgcatggacgtcagtagcaactccaagtcccagcttctcaacgccgtcctcagcccgggccacaggcagtgggactgcttctggcatcgggacctcaacttgggcaccaatgcccgggagatttcggatgggttggtagaaatttcctggttttttcccagcggaagggaggacttggacattttcccagaacctgtggcctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacagaagggacgagctgaggctgcagggggacccctggagaaaggcagcccaagtggagaaggagttctgccagctccagtgggccgtggacccccctgagaagcacagggctgagctgaggcggcggctgctagaacttcgaatgcagcagaacggccatgatccctcctcgggggtgcaggagttcatctcggggatcagcagcccctccttgagtgagaagcagtacttcctgaggtggatggagtggggcctggcacgggtggcccagccgcgactgagacagcctccggagacgcttctcaccctgagaccaaagcatgggggcaccacagacgtgggggagccgctctggcctgagcccctaggggtggaacacttcttgcgggagatgggacagttttatgaggctgagagctgtcttgtggaggcagggaggctgccggcaggccagaggcgttttgcccacttcccaggcttggcctcggagctgctgctgacagggctgcctctggagctaatcgatgggagcacgctgagcatgcccgtccgctgggtcacagggctcctgaaggagctgcacgtccgactggagagacggtcaaggctggtggttctgtcaaccgtcggggtgccaggcacgggcaagtccacactcctcaacaccatgtttgggctgcggtttgccacagggaagagctgcggtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgaggaaaagacagggtttggagtctcctcaacagtgttaaaagaggaagtgacctcacagaccagctcagagatgttaccaagaatatcacagcccccagggtagggagacaagcagcagtttgttctgtctcagctcctgtcaaggatcctgcggggtgggccctctgtatagctgctctctgtcactggcccctggagtgggagcagcgtccttagtcactgcaggcccaggcgggcaggtggtcccaggacagaggtggggaagttgtcctgaggaagcagaagtaggccttgctcccgcccaacccaagggcctccagtggaccagcattcaagatgtgagtgcccgtggtgtgcaaggcactcccatggcaccgtatttattgactgatctgtgaaggcttccctgacccctgcccaggaagagttcactggtcgctctgttgtgccccacagcactttgttatacctctgccacacacttcacgcagcgcgttgtaactcatgtgtttacatgtctgtccccccagactgtgagctccttgagggcagggactgtacattctccagctctgtgtccccagggcctggcacattgtagacgcttaataaatgtctgttaaatg

SEQ ID NO: 33878 - DNA, 591 bp, Homo sapiens
acgctggccacccgcacctggtcctgtggcttcgaccactagtcagcaaggccccggagaggccagcgaagaggaggggctcgttggctttacggagacgcgcggagcaccctcaaggtgccacacgctcgcctgctccctgttcctacatcctgggcgtcttcccaggctgtcatataactcctgagaatagtggttcttaactctatttggaatggagagaaatggaaggagatgattgcgagttccgttatggagatggtacaaatgaggctcaggacaatgattttccaacagtggagagaagcaggcttcaagaaatgctgtcacttttgggcctagagacgtaccaggtccagaaactcagcctccaggactctctgcagatcagttttgacagtatgaagaactgggcccctcaggttcccaaagacttgccctggaatttcctcaggaagttgcaggccctcaatgctgatgccaggaataccactatggtgctggacgtgctcccagacgccaggcctgtggagaaggagagccagatggaagaggagatcatctactgggacccagctgatgaccttgctg

SEQ ID NO: 33879 - DNA, 2074 bp, Homo sapiens
ctgggccgcgaggcgcggggagtggccctaagcgcggggctgtacggggagggccgaggcgtggggcgaacgccggggcggggtcggggcggggccgggggaggcggaagcggcgcgtgaacctaagtcggagtcgcgttgaagccagcgtccggccggcagagcggcgtcggcggggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatga

SEQ ID NO: 33880 - DNA, 4148 bp, Homo sapiens
gtcgcgttgaagccagcgtccggccggcagagcggcgtcggcggggttggccggggcggtgtggcgctagagcctgggcgggccgggggcaaggagtcaaggcttgggggcgggtgacgggcgggcggagggcttgcccccgtgtggtcctcggagcggcccgaggtccagcctcccagcggtcccggaggaggatgcgaccggggggccccgggcggggcggtcggcggcggctgcagcgctagcggcgcgggggctgggcggcggcgccggcatgaggcgcagggccggtgtccgcgggagggtggcgctgccggcggcccggccgctcccgctgcaattgctcgctgggctcgtcgtgccctgccagtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgcaaa

SEQ ID NO: 33881 - DNA, 3669 bp, Homo sapiens
agtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagtgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgc

SEQ ID NO: 33882 - DNA, 581 bp, Homo sapiens
gtgcggggacgcagcgaggccaccccggctgggaacagccgcgtgggcggggccgcattgcactctctggacagttcctgggccgcgaggcgcggggagtggccctaagcgcggggctgtacggggagggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgat

SEQ ID NO: 33883 - DNA, 4997 bp, Homo sapiens
agacacacaccagtggcgacaggggagagttggaaagacgcaggagagaagcaggaggcaggaggcagcggggatggagcaatgggagcgggaagcaggcaggtttccttgcaaatccccctccggcctcacgccgtctcgccggccccggcaggggagcgaggaccccggcgaacagatggaggagtggagctcgctctaggcagctgggcttggccggagaatggaggagccaccaagcgaccggctgattggaagagaaacgcagagcgatggaggcggggtaggaggacgatttctctgcggggactggcggcggcgtacacgcccgggtcgggcgctgcagagcttggctggctttcaacccgcgctcgccggctccagccccgcgcgcccccacccctagccctcccggcggctccgcagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttatttttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtttga

SEQ ID NO: 33884 - DNA, 4684 bp, Homo sapiens
cggagcggcgctgcgctgcgccgaggcgggcgggcgggcgggcggagcggggcgggcggagcgcggcgcgtggggctcgccattagccgtcgctccgcttcgccatctcgggctttgtctggcgactcgctgccccggcgtcggctgcagcggagctgcggctcgactgttcggcccgccgtgctcccaggtgcccccggcctgcgctcccatccacacgctcgggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttatttttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtttga

SEQ ID NO: 33885 - DNA, 2683 bp, Homo sapiens
gcggcggggggtgtgcgagctgaggccggggccggcggcgggcgggctgcctgcaggcggagggcgctgtgctttgtgcttttcgccgcgaggagcagcaggcagcagccacagccgccgccgccgccgccgccgccacagcagcagcagccgccgccccagcgccgccgcctcgcccggaggaggagccgctgccgccgcgggagggagctgcggctgtgcccggccgagcgggggagggcgccgccactcagagccagggagggagccgctggagcgggaagcccggaggccgcgctgcgccggggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttcttt

SEQ ID NO: 33886 - DNA, 2738 bp, Homo sapiens
agagccagggagggagccgctggagcgggaagcccggaggccgcgctgcgccggggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagt

SEQ ID NO: 33887 - DNA, 2459 bp, Homo sapiens
gcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgagg

SEQ ID NO: 33888 - DNA, 2570 bp, Homo sapiens
gcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgagg

SEQ ID NO: 33889 - DNA, 3011 bp, Homo sapiens
cttggctcggctccccggaggccggggcgggggcgccggcggggctgggccgcaggctcgggggaggaggcggcggttcccgccgcggtcgcgcctctgtgccgggctcctccggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctacc

SEQ ID NO: 33890 - DNA, 998 bp, Homo sapiens
acttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatccc

SEQ ID NO: 33891 - DNA, 1717 bp, Homo sapiens
tccattgaaaattttccttggataggaaaggacttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtgggggtcgttttttttttttcttttcttttttttttttttttttttttttttttaagataaaattgttcaaagcca

SEQ ID NO: 33892 - DNA, 1807 bp, Homo sapiens
gcccctcaccaacatggccgcgggctggaagtgcgcatgagcagctgtctatggagatacctaggccgggagagggagaacacagttggagaaaatcggcagctgagacggccttggccggacttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtgggggtcgttttttttttttcttttcttttttttttttttttttttttttttttaagataaaattgttcaaagcca

SEQ ID NO: 33893 - DNA, 1765 bp, Homo sapiens
aacatggccgcgggctggaagtgcgcatgagcagctgtctatggagatacctaggccgggagagggagaacacagttggagaaaatcggcagctgagacggccttggccggacttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtgggggtcgttttttttttttcttttcttttttttttttttttttttttttttttaagataaaattgttcaaagcc

SEQ ID NO: 33894 - DNA, 2290 bp, Homo sapiens
aaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgaccgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggaagcttgatctgcccagggaagctttcgaagctgcctccagagaagactttgaactgcagggatatgcctttgaagcagcggaggagcagctgagacgaccccgcattgtgcacgtggggctggttcagaacagaatccccctccccgcaaatgcccctgtggcagaacaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaatgcccaggtactgcttgtgcaggtggatttgaggttaggcagatgatgctgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatccccta

SEQ ID NO: 33895 - DNA, 3418 bp, Homo sapiens
aggagacctaggtaccagactttgctttgccagtgcctctttctgtggccttgggtaagtttttcccctctctgggcctcagtttcccatttgcaaaataaaagtgtttaagactaggttccaagattttccaattctaatgctgagaggatacagaggaaaacagaaagaatgctggctgaggaaccaggagacttgccttcttgtcccagctctgccactgacctgacctctttgggcctctgcttcctcatctataaaataagataaagcaacagaagcctccagcgactaagttaaactttcctggggtcacaaggtttacaagtggctgaataggatttctacagactggttccttcacccggctgcccgccgaagtaagcgggccttactgccctaattctcaataggaccccaaagaggacgcttctttgctcctgaagggatggcaccctctggattcgcggtaacagcaaatggggctctcactcctaccatctcagtgacagtttaaagcgcaccctaccgcaggaaagtgcccatatttgcacacacgcggcagagggcagggctgaaaaggggccctagggtgcagggggcgcgccctcacccggggaccccgcattttacaatattagctccaccgaggcgcacggaaccgcaggcgagcaactgaccttcggctccagcggccccaaagccgggggtgggaacgcgcgacccaggtagcggcatggactccgagcctggcccctcgggggttaaaactccccagacataaaggctccggacgacagaggtgcagccgccgcgtgcccgtgggacactgaaactcttcccttaccttcctcggtagtcctgtgagggaggctggcccggccggctgccctacggtgcggacaggaggtcgcggtcgggaggggccctgcccggcggttgctgctggaaccagcccccgcaagggcccgcagcggccgggccgtttacctcagacccgcgccgcagcctcccggagcccgcgcccaggactccctcacgacctctccagggtcccggcccgacaccaaggggcaggtgaggggtggaacctggaggcacccgcgccagggcccctgagggaggcgggagggggacagcctcagtcctgactcgcagccgaggcgcgacgactccgcgcagtcccgcctgtggaggggcgtgcctcatcgcttgctaaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgaccgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaatgcccaggtactgcttgtgcaggtggatttgaggttaggcagatgatgctgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatcccctactggttctgcttctctagttgaatctgactgatacagattttggtgccaaaagtggttctagaaaaatagaatcttaaagatg

SEQ ID NO: 33896 - DNA, 4726 bp, Homo sapiens
ggattggctgcgcgaggaagtggcgtgtcctcacttgagctgtctgggagcgagagtaagagataaaggcaagggcgcctgaccgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggaagcttgatctgcccagggaagctttcgaagctgcctccagagaagactttgaactgcagggatatgcctttgaagcagcggaggagcagctgagacgaccccgcattgtgcacgtggggctggttcagaacagaatccccctccccgcaaatgcccctgtggcagaacaggtctctgcccttcatagacgcataaaggctatcgtagaggtggctgcaatgtgtggagtcaacatcatctgtttccaggaagcatggattctccgtccacatcaccaggaaccccggcctccctgctgttacgcaccgagctgttgtctgattccttcagttttcccacatcgttctgaatccattcgctcctctccatctctctaccaccacctggtccaagcccctggcagctcacctctggcttttgtaattccctccagctggtctcctgtgccctcctgaccaggacttctttaccttcagatctcagcccagagccagcccccccatctaaacatcctggtagtatgtacctttgtggtttttatttttatcagagttttacatgctcatggtttagagtcagatgggtgtacaaggtctgttaccaaaaaatagctattatccccagcatcaacactgagctagttcctttggaatttacctttgttagtgttgctacttcctaattttttagttttgcatcacctattgacttccccctatggaagatgtcagtgttagccctttcttgcctcctcctggcccttcgacatacatgtgtccttgttctatccccccagcccattttgtcaactttgattccttttctttttttttaagacaaggacttactctgtcacccaggcttagagtacaatcacagctcactgcagccttgatcccaggcccaagcaatcctcccacctcagcctcccaagtagctgggaccacaggtgcacaccatcacgcccagctaattgaaaaaaaaaagtttgtagagatggagatctcactatattgctaggctgaactttgatttcttttcctgaattattttctgttttccctagagtttgctttgttttctacttgccacgcattcaaccccaaactttctatcaattcctaaatctcccttaatgtgttttagacgcatcaaacagtctatcagtttcatctcctccaaggaatctgccccagagccttgtgactgctgtggtctgaatcaggtgccccctctgctggccacacagttattgtcctgggatcccccctcatcatcaccctggggaatccctttgccttgctcttgtgtttctctgttcccacagcttcctctttcttggtttatacccttattttagtggagtggtgtagtggatccttatagatttatgttgcctcggcatccatgttgaatacaagtttaactctctcataccagcggcagggctcggtcacgctggacacagtttccagatctacaccacaccgagatggctcaagccaagtggccagaggtaagaacttaagaggcctctctcccaccagcagactgggctgcccactttcctgctgcttcctttaaatggaccatccaggcatttggccattaacttaaggtgaccacatcttagtcattatgtgtactgctagttgccccatactctctctgactcttcatttctccctcatctgacctggggacagaggactgccctcctgactcatggcactctccttgcccaggatctgtaagtaaaaaaatctttaaacttgtttcctattgcgattgtgtgttgaatttgcaccttccatgagaagaaccaggggctgccccaggctgggttttccttgggataccggtggaaacacaaagttgggctcctagggccagagtggtagtcaggcagggacaggtcaggcaagagctgccacacagcatgtgccagtataaacaagtttcacgtatgagggaccccctggtcacgggttggacagacaggcattaggctgtccaccatgtacaagatgtatcctgtgaaaggcacactgtagagaccacatccagctcccttcatttcctgttagtgctgggttgccaaccgctctggtactggagcccccatttagctagggactctcagaacaagtagttccctgaggaagaacacatcagaggtaaactttttgaggccttgcccatctgaaaatatgttccttctacaattttcttgatagtttggttgagcatcaaattttaggttagaaatcattttccttcagaagtttgaacacattgttccattgtcttctagttttttgggcattgttgagtagtccacagccattttaatttgtgacccattgtctatgacttgtttttctctggaagactgtaggagtttctctttttcaccagtactctacaatttcataatgatattccattgtgtatatctattttaatccactctaggcactcagtgggttcttttagtctagaaacttgggttctgaagctctaggaaatgttcttgcattatttcattcattattttcccctctttttttctctttctagacagtcctactattaggatgttggaaccctggactagttccctaattttgttatgtatttcctccttttttttttttttttttttttgatacgtggtcttactctgtcactgaggctgtagtgcagtggcacaatcacagctcactgcagccttgacctcccaggatcaagcaatcctcccgccccagcctcctgagtagctgggaccatagatgcataccaccacacctggctaattttcttgaatttttttttttttttttttttgtaaagatgagatctgtgttgcccaggcaggtctcaaattcctgggcccaagcaattctcccaccttggactcccaaaatgctgcaactataggcgtgagccacagggcccagtcaccactttgtctttttgctcaattttctggtggatttgatctgatttgtcagtcagccctcctattcaacctttcatttctgctgtcaaattttgaatttactagtgttcttttggtctgaaagtccctgttgtattacatcctgttcttgcatcatggttgcgatatcttctcttacctctaaggatactaatattaagtaaattttgttttctctcttattccaagagtccttattccaagttggacgctttgtttgattgctcatattttaagaattggggattaaaaatctgtgagctctgagtttgtagtaggggctcacccactgagctccattatagggtgatctgatttagtggtaattcccaggtaatcccagtgttagtatctctgggtcattcttttcaggctggtcagagtccccagagatttttctgcccttgtgccaagaagggaaggagaacaaaggttcagcatgctgatgtttactcaatccctctgttttgacacttcacttgctttcatctgccctgctccaaagccagagagcctctgctgaaccatctctggaggatgagcctctggccttcttctggggtagatggggcaggtcccagcctcttggtgtggagaaaggacctggatttctaactgcttctttttttatttttatttttatttttttttgaggtggagtcttggtctgtcacccaggctggagggcagtggcgcgatctcagctcactgcaacctctgcctcctggattcaagcgatttttctgcctcagcctcctgaggtcaggagtttgagaccagcctggccaacatgatgaaaacccatctctactaaaaatacaaaaaaaattagatgggcatggtggtgggctcctgtaatttcagctacttgggaggctgaggcagaagaatcgcttgaacccaggaggtggaggtttcagtgagccaagatcgtgccattgcactccagcctgggcaacaagaacaagactccatctcaaaagaaaagaaaaaaagaaagaaatgcacttgggttattgtgaggtgggagatctacaaagtatactgaattagtccagacaaggattgagttctccacattgagaaagaaaaagacgaatagcacagtaggaaataggcaaagggtatgaacaaaaaaatgtaggggaggaatccagactggccagtgaatgtgtggtgaggggttcagcctcaccggggatatgggaaacatttactcacagtgaggcaccgttcacaccagcagactggcaggtactaaaggtaactccatgcactgcagatattcacgtgtggctgggctgtagagcagcattaggcacatagccaaaggtcccaagggcccaccccagcggagtcccctccatcccctgcataggagactgctctgaacttggtgtgcatggagatgaccagtatctttgaactgttaatctgtgtgtatgtacctactgttt

SEQ ID NO: 33897 - DNA, 2658 bp, Homo sapiens
ctgcagacgaggcaggcggaagaggcgggacttcgcgggtgacgtcatcggggcgccggaggcccggggcgcctgggaatttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagcacagcttttcttgtgtcctgtattctctgtctaatgtgttgcccaaataatacctaattgttagccattcccctccatctctggcctaaaagtgatagtccaggtatccacatgggctggttcccagaactgccattgctcactctccaaagaggggaaggtggggaaggggaaggtgactatagctcagctcctgagctagtatctggctgttatttcaacaaccggagttggggtttgggctcattttttcccctagccagcaattatggaccagtagtaacacaagtgacagcttcctgtgactgacttcacaattaggaggtctaagattccatttgggtatttgcttaaggatcccacataattgtcccaacggtcattagtagaggggaggtaagccttcattaataataaagagaaagcccacattcaa

SEQ ID NO: 33898 - DNA, 1691 bp, Homo sapiens
caaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagc

SEQ ID NO: 33899 - DNA, 2235 bp, Homo sapiens
caaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcagatgggatctctcttacgtcacccaggctggagtgcagctctgtgatcatagctcactgcagcctggaactcctgggcttaagagatcttcttgcctcgggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagc

SEQ ID NO: 33900 - DNA, 1982 bp, Homo sapiens
caaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagc

SEQ ID NO: 33901 - DNA, 1932 bp, Homo sapiens
gcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccacgtggggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgca

SEQ ID NO: 33902 - DNA, 1822 bp, Homo sapiens
caccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccacgtgggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacatt

SEQ ID NO: 33903 - DNA, 1375 bp, Homo sapiens
tgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaa

SEQ ID NO: 33904 - DNA, 864 bp, Homo sapiens
ggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccacgtggggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtggg

SEQ ID NO: 33905 - DNA, 974 bp, Homo sapiens
agactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggatagggattttgaagcaccttaggagaaaagacacaggaaaatcaaaggggggaagagagaggcgcagtacaaaactcagataagtgtccttaaattagcttaaaatgtccctatcctcaacagggacattttttttttgtttaaaaaacaaagatggttggccgggcgcggtggctcacacctgtaatcccagcacattgggaggccgaggcg

SEQ ID NO: 33906 - DNA, 778 bp, Homo sapiens
ggatggcgccgcgggtgtagcggctctctgcgcaggccgagtgggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaagtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtcc

SEQ ID NO: 33907 - DNA, 682 bp, Homo sapiens
caggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaa

SEQ ID NO: 33908 - DNA, 918 bp, Homo sapiens
attcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtggggcggtgacggaggctctggtgcaccttggctgtgagctgcagaggagcagagagcggcccggcgcggctgcgcggggaggcgggcgcgcggccgggaggttctggggctggtgtgtgcggagcgagggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggt

SEQ ID NO: 33909 - DNA, 2063 bp, Homo sapiens
gcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagacaaagaagtatgccgatgtgatcatcccgcgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccatgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaa

SEQ ID NO: 33910 - DNA, 2051 bp, Homo sapiens
ccgagatggcttcggcgggaggcgaagactgcgagagccccgcgccggaggccgaccgtccgcaccagcggcccttcctgatagggtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccgcgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccatgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaa

SEQ ID NO: 33911 - DNA, 2114 bp, Homo sapiens
cccgatgcgcgggagcggaggccgagatggcttcggcgggaggcgaagactgcgagagccccgcgccggaggccgaccgtccgcaccagcggcccttcctgataggggacgagcggttccaggcgggaatcccgcttctgtgtctccagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccgcgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccatgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaa

SEQ ID NO: 33912 - DNA, 2167 bp, Homo sapiens
gctccggttgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccgcgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccatgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaa

SEQ ID NO: 33913 - DNA, 1833 bp, Homo sapiens
tgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaa

SEQ ID NO: 33914 - DNA, 1876 bp, Homo sapiens
atgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagggctgcgctggcctcggcacaccagtgccacccgctgccccggacgctgagcgtcctgaagagcacgccgcaggtacggggcatgcacaccatcatcaggtgagggcccacctggggacggggcggccccgggcgcgtgctcccgctcaactgttggccccacagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagcttt

SEQ ID NO: 33915 - DNA, 1827 bp, Homo sapiens
atgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagctcaggtttgtccccagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagcttt

SEQ ID NO: 33916 - DNA, 1954 bp, Homo sapiens
agtacggtggaggcttcaagggcctcctagctgctgtgcctctgctgacatttggcaggcagcttctgccagccaagggtctcaccccagccacccggctctgcacccactgtgctgcccacaggagtggtcctgcccatggaagggccagttcaggtggccggagctcctgagctgccctaggggactgctgtgggtctgaggtggtgatgtcccccacggctgcctgcgcctgagcccccacgcatccacccctggggccactctgctgttcaggagcacccacccgtgtcctcgaccatgagcagccccccagcttaccctggcatcaggatctcagggtgccgggcccttggagcagaaggcagcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgaccca

SEQ ID NO: 33917 - DNA, 422 bp, Homo sapiens
catggaagggccagttcaggtggccggagctcctgagctgccctaggggactgctgtgggtctgaggtggtgatgtcccccacggctgcctgcgcctgagcccccacgcatccacccctggggccactctgctgttcaggagcacccacccgtgtcctcgaccatgagcagccccccagcttaccctggcatcaggatctcagggtgccgggcccttggagcagaaggcagcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcg

SEQ ID NO: 33918 - DNA, 888 bp, Homo sapiens
ctttagttcccccggggagaggctggggacaagctacccattctggggtatgacacctatcagcacgtgtgagcccgccctgtgcccggcccacttctgcttcctcttagcgcaggaggggtcccgcactgggaggggccctcacagcctaccccgctagctttctgcctgatggtgagcttgccccgttgttcgccgccatctttcgcctttgcctgacagctcaggtagggcgacgtctccccccagctcagccccaggcagaagtcaggcccgctctgcacctcgtgctgtgcctggcccgtgtgttcccctcacagtgacgcacagccgtcctgtggggagggagggctctgggaaaagacccccttcttgagtgttccccatcggtttgtccccagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctg

SEQ ID NO: 33919 - DNA, 1375 bp, Homo sapiens
ctcgccgcctccgcctcggcgaatagcagcgcgctgcccgcccggattggagcagcagcatcacgctgacctctgcctgggatgtaaaccggaccagccgctgcgggcaaaggaaggctcttggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaagga

SEQ ID NO: 33920 - DNA, 1202 bp, Homo sapiens
gcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccgtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgtttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaaaaccttgattgcctcctctgtcacatgccactc

SEQ ID NO: 33921 - DNA, 3149 bp, Homo sapiens
agtctcttcctggcctccccacagtgctggcctctgcctccatctcagtcacacatgtctagcctccaggcgctgtgctctggcctgcccctgcggcccctcccagagaaccggggacgccaggctggggtgccccatgcccctgtcaggacccccagcctcagccctgtggagaaacagctggcgctgaggaacgccctgcgctacttccccccggatgtccaggagctgctggccccagagtttgcccaggagctgcaactgtacggacacatctacatgtaccggttttgccccgacattgaaatgagggcctacccgattgagcagtacccctgccagacgaaagtggctgccgccatcatgcacatgattatgaacaacctggatcctgccgtggcccagtttccccaggagctggtgacctatggaggaaatgggcaggtgttcagcaactgggctcagttctggctgaccatgttctacttgtcgaagatgacagaggagcagactttggtcatgtacagtgggcacccacttggcctctttcccagcagccgcagtgccccacggctcgtcatcaccaatgggatggtcattcccaactactcctcccggacggagtatgagaagctctttgccttgggggttacaatgtacggccagatgacagcaggtagctactgctacatcggtccccagggaatcgttcatggcactgtgctcaccgtgttgaatgctgcacgtcggtacctgggcatcgaggacttggctgggaaggtctttgtcacctctgggctcggcggaatgagtggggctcaggccaaggccgcagtcatcgtggggtgcatcggtgtgatagcagaggtggataaagcagcccttgagaaacgccacaggcagggctggctgatggaagtgactgacagcttggaccgctgcatccagaggctcagggaagcaaggaaaaaaaaggaggtgctcagccttggttaccatggcaacgtggtggctctttgggagcgcctggtccacgaattggacacgacgggggagtgcttggtggacctggggtcagatcagacatcctgccacaacccgttcaatggcggctactaccctgtgcagctcagcttcacggaggcccagagcctcatggcctccaaccctgctgtgttcaaggacctggtccaggaaagcctgaggaggcaagtctcagccatcaacaggttggccgaggagaagttcttcttctgggactacggcaatgccttcctcttggaggcccagagagcaggagcggatgtggagaagaaaggtgctggcaggacagagttccgctacccttcctatgtgcagcacatcatgggggacatattctcccagggatttgggcctttccgctgggtgtgcacatcgggggacccccaggacctggcggtcacagacgaactggccacatctgtgctggaggaagccattgctgatggagtgaaggtgtctgtgaagctgcagtacatggacaacatccgctggatccgggaggccgccaggcaccggctggtggtgggctcccaggcaaggatcctgtactcagaccagaagggccgcgtggccatcgctgtggccattaaccaggccatcgcctgcaggaggatcaaggcgccggtggtcctgagccgagatcaccatgacgtgagcggcaccgacagcccctttagggagacctccaacatttacgacggctctgccttctgtgcagacatggctgtgcagaacttcgtgggagatgcctgtcgcggagccacctgggtcgcccttcacaacggagggggcgtgggctggggtgaggtgatcaacgggggattcggcctcgtgctggacggtaccccggaggccgaggggagagccaggctgatgctcagctgggatgtctccaatggtgtggcccggcgctgctggtcagggaaccagaaggcctatgagatcatctgccagaccatgcaggagaacagcaccttggtggtgacactgcctcacaaggtggaggacgagcgggtgctccagcaggccctgcagctctgagggagccaggagtcgcggcccctgcctcccttcctccctggcgatcctcacctgcccagccatggcacacacccttcctgcacacccgcactacctgcacttctcgcacatcctcacgtggcccttatggtgccctgtgcagggtgccaccacagcctcattttacagacagccccctgaggcccagagacatgcagctctctgtccacaaccatgccacttgcatgggagccctgaaggctgtcaaagtccatttagggccaagtcccaagcctgcccgggggccctgcggtgaacactggtcaagctctctccggctgggatgatcacaccctctgcttcctggccacctgccagcctccatgcaactctgtctgtctgctgcccatctgctgtctgtgcaagcaacttctggaccctggcaccctgggctgctggcctggaggagttcgggaaggaggatagaccaggaaataaagggtcaacagagctgtgtgctgcactgtgggctggtgggacgggcaggccgggtctgccctaaggataaatgatcacttactggggaagaaatgagagagcaggggcacccccctaggccagcacagcctgaggggtacagcaaaggggaccctttgctggcccctgaggctggagtctggcaccccttccccaatcccatagcccggtaatgactgggtccagagcctcgtgagaggtcaccgggatgggggaagtggcctctgtcagggccagggctcatgaatctcattctcttagctgggcgtgcaacagaccaacagataactcatcctaaacagagaaatgagaaagagtctgtgggtgggcctctgagggccacagaaaaccagacaccccacatgtcggtggattggagaggggcaggccactgccctctccaggaccaagccgggttcttggtccccaccctccctgcactccgcatctcctccccagcagccattctcccctttcccttgtgaacaaaagcctagttttgtgtgggcagcaatatagggtaaataaaaccacctgattctccagcc

SEQ ID NO: 33922 - DNA, 2735 bp, Homo sapiens
acagtgctggcctctgcctccatctcagtcacacatgtctagcctccaggcgctgtgctctggcctgcccctgcggcccctcccagagaaccggggacgccaggctggggtgccccatgcccctgtcaggacccccagcctcagccctgtggagaaacagctggcgctgaggaacgccctgcgctacttccccccggatgtccaggagctgctggccccagagtttgcccaggagctgcaactgtacggacacatctacatgtaccggttttgccccgacattgaaatgagggcctacccgattgagcagtacccctgccagacgaaagtggctgccgccatcatgcacatgattatgaacaacctggatcctgccgtggcccagtttccccaggagctggtgacctatggaggaaatgggcaggtgttcagcaactgggctcagttctggctgaccatgttctacttgtcgaagatgacagaggagcagactttggtcatgtacagtgggcacccacttggcctctttcccagcagccgcagtgccccacggctcgtcatcaccaatgggatggtcattcccaactactcctcccggacggagtatgagaagctctttgccttgggggttacaatgtacggccagatgacagcaggtagctactgctacatcggtccccagggaatcgttcatggcactgtgctcaccgtgttgaatgctgcacgtcggtacctgggcatcgaggacttggctgggaaggtctttgtcacctctgggctcggcggaatgagtggggctcaggccaaggccgcagtcatcgtggggtgcatcggtgtgatagcagaggtggataaagcagcccttgagaaacgccacaggcagggctggctgatggaagtgactgacagcttggaccgctgcatccagaggctcagggtccttcagctgggattgcaacaagccctgggctgggccggcctccctgctgccctgggactgtgtgtcctttcctgctttgtcaaccttgcacccctgggggaggggaggtgcctggctccctcgggcttctccaggccactcctgggggcacctgttctgcttttgtgtccttccagggaagcaaggaaaaaaaaggaggtgctcagccttggttaccatggcaacgtggtggctctttgggagcgcctggtccacgaattggacacgacgggggagtgcttggtggacctggggtcagatcagacatcctgccacaacccgttcaatggcggctactaccctgtgcagctcagcttcacggaggcccagagcctcatggcctccaaccctgctgtgttcaaggacctggtccaggaaagcctgaggaggcaagtctcagccatcaacaggttggccgaggagaagttcttcttctgggactacggcaatgccttcctcttggaggcccagagagcaggagcggatgtggagaagaaaggtgctggcaggacagagttccgctacccttcctatgtgcagcacatcatgggggacatattctcccagggatttgggcctttccgctgggtgtgcacatcgggggacccccaggacctggcggtcacagacgaactggccacatctgtgctggaggaagccattgctgatggagtgaaggtgtctgtgaagctgcagtacatggacaacatccgctggatccgggaggccgccaggcaccggctggtggtgggctcccaggcaaggatcctgtactcagaccagaagggccgcgtggccatcgctgtggccattaaccaggccatcgcctgcaggaggatcaaggcgccggtggtcctgagccgagatcaccatgacgtgagcggcaccgacagcccctttagggagacctccaacatttacgacggctctgccttctgtgcagacatggctgtgcagaacttcgtgggagatgcctgtcgcggagccacctgggtcgcccttcacaacggagggggcgtgggctggggtgaggtgatcaacgggggattcggcctcgtgctggacggtaccccggaggccgaggggagagccaggctgatgctcagctgggatgtctccaatggtgtggcccggcgctgctggtcagggaaccagaaggcctatgagatcatctgccagaccatgcaggagaacagcaccttggtggtgacactgcctcacaaggtggaggacgagcgggtgctccagcaggccctgcagctctgagggagccaggagtcgcggcccctgcctcccttcctccctggcgatcctcacctgcccagccatggcacacacccttcctgcacacccgcactacctgcacttctcgcacatcctcacgtggcccttatggtgccctgtgcagggtgccaccacagcctcattttacagacagccccctgaggcccagagacatgcagctctctgtccacaaccatgccacttgcatgggagccctgaaggctgtcaaagtccatttagggccaagtcccaagcctgcccgggggccctgcggtgaacactggtcaagctctctccggctgggatgatcacaccctctgcttcctggccacctgccagcctccatgcaactctgtctgtctgctgcccatctgctgtctgtgcaagcaacttctggaccctggcaccctgggctgctggcctggaggagttcgggaaggaggatagaccaggaaataaagggtcaacagag

SEQ ID NO: 33923 - DNA, 795 bp, Homo sapiens
tgcgtccagtgctgcttccagcgctagccccaggggcacgaaggctggtgtagggaggtgcgcccctccgggggcccgccagccgtcagactcgaagctgtggctgtcattgcttctacaatcagtgcatgttcttcgctgacgtcagtcggagctgtcctggcactatataaggctggcgacagccccgggacagaccctgtgttccccaaggcgtcttcagcctgccccgagggacagagactggagctcaatcttggaccgtacagacgctcgccgacaacctggccggcggcaccatgaggcaggcgggacgcgcagcgctgctggccgcgctgctgctcctggtacagctgtgccctgggagcagccagaggagccccgaggcggccggggtccaggacccgagtctgcgctggagccccggggcacggaaccagggtggcggggcccgcgcgctcctcttgctgctggcggagcgcttcccgcgccgcgcggggcccggccgattgggactcgggacggcaggcgagcggccgcggcgggacaacccttctctgtccattgacctcacctttcacctgctgcggaccctgctggagctggcgcggacgcagagccagcgggagcgcgccgagcagaaccgcatcatattcgactcggtgggcaagtgatggcccggtttggggctgcgaaaacgttgacccctttcccccaccccagagttgggatgcggggcagagccaccagggcactgtctgcgtgactattttttaataaaagtactgaagaccc

SEQ ID NO: 33924 - DNA, 1481 bp, Homo sapiens
ggacagtagtgcctggccccagccccaggcagccacagcaggctgccttaccccagaagcagctggtggcgcctgacctcacgatgaccaggtgtgctctgctgttgctgatggtcctgatgttgggcagagtcctggttgtcccagtgacccctatcccaaccttccagctccgccctcagaattctccccagaccactccccgacctgcggcctcagagagcccctcagctgctcccacatggccgtgggctgcccagagccactgcagccccacccgccaccctggctcgcgcattgtcctatcgctggatgtccccatcggcctcttgcagatcttactggagcaagcccgggccagggctgccagggagcaggccaccaccaacgcccgcatcctggcccgtgtcggccactgctgagcctgagagagggggtcacagtgatagggccaccctggatgggaagacctggagggcagccacacagctggacggatgctgccacatctgggcatacagtgtctggacgctgccacatctgggcatacagtgtctggacactgccacatggagccactgtcatgcaggtcatatcagatctgagtgccccacagagtcacagtgtgtctggacagcctggacattggacattgctaagttgggtcactgccacatggagtcttgccatgcctgtgtgccccacagacctaatatatgtccggacagcttggatgctgccacgtaaggtcactgctgtggcgagtcttgctatgtctgggtgccccatagtcacagaacacctggacaccgccacatgcagtcatcatcatgttactttcaggagcctcaacacgagagctcaacactgcctccgaccagtccctctgaggcccacaggtctgtcatcccataggccaccacacagagaaatgctggctgagggtcacttgcttgctctgtgccccatgaggcagcacctgccccagatggacggggctgtgaggggtgtctccaggcacaaaggcccgaacacaggaagcctgtgaccatggcagccttgtcttatgggcgcatatgtgcgtgtgtggctgagtctctgacagctgtgagtgtgtgtgagcagggtaagggtacgtgaggggtctgagaggagtgggtgcttgtcccccaaacctgcatgaagcaagaacaactcctggccaggccctgtcctccccacgtacccctgcatccccagcctcgacccagggacatgcagggctcacaggagacagggctcaggctgccggagctccaaccaaactctgtcccacttcacgcacggactgtcctgggcaaaggtgttcacctttccgagcctcggtttccttatctgtaaagcaaagcgacaccagcaagcctgtgagcattgtgtatatagcagacatggaggtcctgcagcaggaggtgctcaataaacacaaagcgactgaaggatgg

SEQ ID NO: 33925 - DNA, 2251 bp, Homo sapiens
agactaactctacctttctggcttcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgccaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctc

SEQ ID NO: 33926 - DNA, 2409 bp, Homo sapiens
aactctacctttctggcttcaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagaacaaagtacaactgcccagccaggtggagttggaggactccgcagagaggaggcgacactgagcagggtcctgatgaagatttcaccagccagggaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgccaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctca

SEQ ID NO: 33927 - DNA, 2315 bp, Homo sapiens
agactaactctacctttctggcttcaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgccaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctca

SEQ ID NO: 33928 - DNA, 2290 bp, Homo sapiens
caggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgccaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctc

SEQ ID NO: 33929 - DNA, 2350 bp, Homo sapiens
agactaactctacctttctggcttcaggtgctatctagacctgaagtagcgggaagagcagaaaggatggggcagccatctctgacttggatgctgatggtggtggtggcctcttggttcatcacaactgcagccactgacacctcagaagcaagaacaaagtacaactgcccagccaggtggagttggaggactccgcagagaggaggcgacactgagcagggtcctgatgaagatttcaccagccagggaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgccaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctc

SEQ ID NO: 33930 - DNA, 2180 bp, Homo sapiens
aactctacctttctggcttcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggctcctgcgggccggggttggactgcgtgcccgagggcgacgcgctcgtgtgcgcggatccgtgccaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctc

SEQ ID NO: 33931 - DNA, 1221 bp, Homo sapiens
atgctcaggacctcggggctggcactgctggctctggtcagtgctgtgggcccaagccaggccagcggcttcacagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaagtacgttcttgagaagttggactttcagagctaa

SEQ ID NO: 33932 - DNA, 1017 bp, Homo sapiens
atgctcaggacctcggggctggcactgctggctctggtcagtgctgtgggcccaagccaggccagcggcttcacagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagcacgtggccttgagatccacttagaacttcgcgccacgtccacatcccacggcaccccactaagctctgcagagaactgtctatag

SEQ ID NO: 33933 - DNA, 5058 bp, Homo sapiens
cgctggtttcctctggaggctgcgagggagaaaccgtcccctgcctctcccaggctctggggtgagcccttcctggcatcccgggctcattgtagatggatcactccaatctccatggcttctcagggcttccctccatgcacctcaaatctctctctccttccttttgtaaggatgccagtcattggatttaggttcaccttaaatccaggatgatctcatctaaattacatctgcaaaaagaccctttttccaaaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtgacctggtgagccccatgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtgttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacagcagcccggaagctcattggaaaggtcagaatcaaaaatgtcaggtactcagaatcctttcgcaacgcaagcagccaggagtatcgagatttcctagaactattcttcaggatggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctc

SEQ ID NO: 33934 - DNA, 5442 bp, Homo sapiens
cgctggtttcctctggaggctgcgagggagaaaccgtcccctgcctctcccaggctctggggtgagcccttcctggcatcccgggctcattgtagatggatcactccaatctccatggcttctcagggcttccctccatgcacctcaaatctctctctccttccttttgtaaggatgccagtcattggatttaggttcaccttaaatccaggatgatctcatctaaattacatctgcaaaaagaccctttttccaaaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtgacctggtgagccccatgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggaggtgcccagcactgccccgggtctggggatggaccaggggagccccagccaggtgaaccccagccaggggagccccagccaggggagcctcagacaggagagtaccagccaggcgagccccagccagaggagcaccagccaggggagccccagccaggtgaaccccagccagcggagcaccagccacgcgaactccagccaggggagccccagccaggggagccccagccaggagagccccagccaggggagcaccagccaggcgagccccagccataggaacactatcggggtgataggcaccacctcctccccgaaggctactgggtcaacccacagcttccctcctggggccacagatggcccactggccctccctggacagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtgttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacagcagcccggaagctcattggaaaggtcagaatcaaaaatgtcaggtactcagaatcctttcgcaacgcaagcagccaggagtatcgagatttcctagaactattcttcaggatggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctc

SEQ ID NO: 33935 - DNA, 4878 bp, Homo sapiens
atgctcaggacctcggggctggcactgctggctctggtcagtgctgtgggcccaagccaggccagcggcttcacagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtgacctggtgagccccatgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtgttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacagcagcccggaagctcattggaaaggtcagaatcaaaaatgtcaggtactcagaatcctttcgcaacgcaagcagccaggagtatcgagatttcctagaactattcttcaggatggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctc

SEQ ID NO: 33936 - DNA, 5262 bp, Homo sapiens
atgctcaggacctcggggctggcactgctggctctggtcagtgctgtgggcccaagccaggccagcggcttcacagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtgacctggtgagccccatgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggaggtgcccagcactgccccgggtctggggatggaccaggggagccccagccaggtgaaccccagccaggggagccccagccaggggagcctcagacaggagagtaccagccaggcgagccccagccagaggagcaccagccaggggagccccagccaggtgaaccccagccagcggagcaccagccacgcgaactccagccaggggagccccagccaggggagccccagccaggagagccccagccaggggagcaccagccaggcgagccccagccataggaacactatcggggtgataggcaccacctcctccccgaaggctactgggtcaacccacagcttccctcctggggccacagatggcccactggccctccctggacagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtgttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacagcagcccggaagctcattggaaaggtcagaatcaaaaatgtcaggtactcagaatcctttcgcaacgcaagcagccaggagtatcgagatttcctagaactattcttcaggatggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctc

SEQ ID NO: 33937 - DNA, 963 bp, Homo sapiens
accctgtgggctcctggtacaacgtcaccatactggtgaaaatggacttcaaggaactccagcaagtggaccccaggctcctgaaccacatgcgccttctgcattccttgatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagcacgtggccttgagatccacttagaacttcgcgccacgtccacatcccacggcaccccactaagctctgcagagaactgtctatagattcctgctctgtggcttccagggtgagaatcctgtccctttcgtgagcacagaaggttggaaaacagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttcc

SEQ ID NO: 33938 - DNA, 998 bp, Homo sapiens
ctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcgcagcccttggacggaggactcatgtggactggtgggcatttcccatttctcaatggctgagctga

SEQ ID NO: 33939 - DNA, 4198 bp, Homo sapiens
cggccctccccatgtgcagccggccagccgggctctcctcctcgcggcggatgggtgaccttttcctggcacgggcaggctgtgggaggcagcggagcaggcgatgaagaagaagcagcagcatcccggcggcggcgcggatccctggccccatggggcccctatggggggcgcccctccgggcctgggcagctggaagcgtcgggtgcccctgctgcctttcctgcgcttctccctccgggactacggcttctgcatggccaccctgctggtcttctgcctgggctccctcctctatcagctcagcgggggaccccctcgcttcctgctcgacctgcggcagtacttgggaaattccacttacttggatgaccatggaccacctcctagtaaggtactacctttcccaagccaggtggtgtacaacagggtaggcaagtgtgggagccgtactgtggtcttgcttctgagaatcttgtcggagaagcacggatttaatttggtcacatcagacattcacaacaaaaccaggcttactaaaaatgaacaaatggaactgattaaaaatataagtactgccgaacaaccctatttattcactcgacatgttcatttcctcaacttctcaaggtttggaggagaccagcctgtctacatcaacatcattagagaccccgtcaaccggttcttatccaactattttttccgtcgctttggagactggagaggggaacaaaatcacatgatccgcacccccagcatgaggcaggaggagcgctacctggatatcaatgagtgtattcttgaaaactatcccgagtgctccaaccccaggttattttacatcattccgtacttttgtggacagcatcccagatgcagggagcctggtgaatgggcccttgagagagcaaagctgaacgtgaatgaaaacttcctgctcgtggggattcttgaagagttggaagatgtgctgctgttactggaaagatttttacctcattacttcaagggcgtgctcagtatctacaaagacccagagcacaggaagcttggaaacatgactgtgacggtgaagaagactgtcccctctcctgaggctgtgcagatcctctaccagcggatgagatacgagtacgagttttaccactacgtcaaagagcagttccacctgctgaagcgcaagtttggacttaagtctcacgtcagcaagccccccctgaggccacacttctttatcccaactccactggaaaccgaggagccaatcgacgatgaagaacaggatgatgaaaagtggctggaagatatttataagaggtgatgtgactgtgttgcctctatggctttatctcccttttccagaaagttctttgtttggggaagtaaaatccttaagggactaaattaatgcttgggtgcattaaaaagaacaaaacattcccacatgttggggtcattgggagatgcccggttttgcgggttttatttgtttaattttattctgtgttttctcttggctctttgggtctttcccgggtacactagatggctccatcccaaggcatcttgtcataaaacagctttcccccaccccatatcatgggaaaagggggagaaatatagcccctagcctaataacttatcatttgtaaaatgacttataaaaatattacctcaatggtaggagacatccagacttgtatatttcagtggaaatacaaaaccacttcagagaccagggtatctcctctggaaggatctaagagaaggtaagacagattaggacatcgaaaaggaggatggagccaggtgccatggcttgagcctataatccgaggctgaggtgggaggatcacttgagcccaggagtttgaggttgcagtgagctgtgatcacaccactgcactccagcctgggtgacagagtgagactctgtctcaattaattttttttttttaaaggaggaggatctccatgggtaagtggtttctacccgcatgggtagagttctgcctctggtccttctcagggggcactttcaccaagagcagtgtaattatctctgaaagagcaagtcagcttgtgccgcatccccaaccaatccacagcctggagtacctttcaaggtcaaagtgcatggccagctccattgagacattccatttcaaagcaccgtgctgacagatatcaaagtactctagcagggaaaataatttgtttgctgtgtaaggaagaatgtagacaagacagataaatctgaaggtcatgtggcatcagggaaagggcatggctgtgtcttttgcacccaatatgaaacatcttctcccaacactgctttaatggaagttctaggaaccaatttagctcaggcatttgactcctacagcagaagttctgagcctgaccacagatggtgtgtaatctatcaaacacacccctggccaagttgggtcctataggacctggtactatgtactattgtaacttctagttccctaagaggtacctgttttcagtaaaaaggggtcctgagttctgtgcaggtggaagagctacccgagaactacctgagttctgtgcaggtagagtcccatttcttatgggacctgtgtgctcctgagaactcttacttgagacatcaaaaagaagcagcaagagcttctgggacagagactgcttggccagctttgtaagtaagtggctgcctccaatgtgatgtgagtacatgttgggcagtctcactgtcctaaggtatgtcttctttccacctcccactgcccctcccctgccacctatcaatgatgccttggttcagtcattagaaatctgttgctttgagttctgaaatattttcaccttaaaaaaaatgctgaaaatacacattctcctgggaagacgataaacagctagctaagaagccgaggttcagtggtggcagcaggaaggacactgccacaaattttgtctatttcatatttgtcccctagagccagccctagcaaatgtgtgagttgggagtagttaatagtaaataagactctgactttacacaagctacacattttatacttttcataaaccacaaagtctctctagaattttttctgccttcactaaaattggactgtagccaagatataaagcaagtcatttggaacctgccgagtgagcactgaagctactttatcatgagatgtgtgttaagaaggctgcagcccacaggagtccagggaaggcggggaccacagaggcacagagtccagcacttggccgctcatgggccttctttctgcctcagaggacgggggcagagaagtgatgaagggaaatgttcttagaggaggaaatatcctttgtcctgttcagagagaccagggccctaccattaggcatactttcagaagcaacctggagaacagctatcaatcatattcaaaaccagtacaagaactgctgcctggtaccctgtgagtcatttctatgaaattccatataaagaatgatgataagtttacacactgtgcaatctcacaatctgaaaataaagttgagttggctgtgttttctctgctcttgtcagaacattgggacaattggtcgttcaaaaacattcatcctcttactgcaagtttatctgggtacttttacctgtgtgttcaaaggcatttcttttcagcagtgatcattataacttcacaaaaaaagatgctgacggatttacttacagggccttaatgttattttgtcccagccaacaccctctaggtcctaaaagtcaaggtacttcagtttatttggcaaacatgacaacattttttttggccctgggcccaacagtttgtacttcatgaaacatattgtacattttacatagtttaatttaaaaaataccttttaagctagttgatctttgactgtcttatttattataacctttcagcacattccaaggttttagttactcaggaaggagttaattaaaatgattttattttggtctgatggatgttttttaaaaggaaaattattattatgaaccttcagcctactttcttgagtgccgtaaaagtgcttgtaaatctttttttttttttaagaagaaagaaaaaaatggtgtttgacgttgatggaaattcaaaaatatatatggaactgaaacattaacttagctaaaataaaagcaatctgtgtttga

SEQ ID NO: 33940 - DNA, 1223 bp, Homo sapiens
atggcgtctgcggcagcagcggaggccgagaagggatctccagttgtggtgggcctgctagttgtgggcaatatcattattctgctgtcaggcctgtccctgtttgctgagaccatatgggtgacagccgaccagtaccgtgtatacccactgatgggagtctcaggcaaggatgacgtcttcgctggtgcctggattgccatcttctgcggcttctccttcttcatggtagccagttttggtgtgggtgccgcactctgccgccgccggtccatggtcctcacgtacctggtgctcatgctcatcgtctacatcttcgagtgcgcctcctgcatcacgtcctacacccaccgtgactacatggtgtccaacccatccctgatcaccaagcagatgctgaccttctacagcgcggacaccgaccagggccaggagctgacccgcctctgggaccgcgtcatgattgagcaagaatgctgtggcacatctggtcccatggactgggtgaacttcacgtcagccttccgggcggccactccggaggtggtgttcccctggcccccactgtgctgtcgccggacgggaaacttcatccccctcaacgaggagggctgccgcctggggcacatggactacctgttcaccaagggctgcttcgaacacatcggccacgccatcgacagctacacgtggggtatctcgtggtttgggtttgccatcctgatgtggacgctcccggtcatgctgatagccatgtatttctacaccatgctctgagggacaggaggggaaggcaacatacacaccccggactcctccgcatcctcctcctgcttcctccgctgggcctggatggctgcctcacctctcacctcccaacgtccctagcccttacgtccttccacttccaagatctttttccaggttcctgagccctactgtgtctcaggtgtgccctgaaaccccagggcttgtgtgcacatatccttagcccatctttcaagggacctctccatgatcccacctcccattcacagatacctctcttgtagctctctgacctcctccttcatggcaggcatcgccattcttgctgaaccgtttgtgattgccatttgagctctggaagcctctattgccatgagagttctgtcacggtcactttactgtccccatcatcacccagcacggggctaagcatatactagatagtcaataaataa

SEQ ID NO: 33941 - DNA, 1321 bp, Homo sapiens
atggcgtctgcggcagcagcggaggccgagaagggatctccagttgtggtgggcctgctagttgtgggcaatatcattattctgctgtcaggcctgtccctgtttgctgagaccatatgggtgacagccgaccagtaccgtgtatacccactgatgggagtctcaggcaaggatgacgtcttcgctggtgcctggattgccatcttctgcggcttctccttcttcatggtagccagttttggtgtgggtgccgcactctgccgccgccggtccatggtcctcacgtacctggtgctcatgctcatcgtctacatcttcgagtgcgcctcctgcatcacgtcctacacccaccgtgactacatggtgtccaacccatccctgatcaccaagcagatgctgaccttctacagcgcggacaccgaccagggccaggagctgacccgcctctgggaccgcgtcatgattgagcaagaatgctgtggcacatctggtcccatggactgggtgaacttcacgtcagccttccgggcggccactccggaggtggtgttcccctggcccccactgtgctgtcgccggacgggaaacttcatccccctcaacgaggagggctgccgcctggggcacatggactacctgttcaccaaggctggagtacagtggcacaatctcagctcactgcagcgtctgcctcccgggttcaagggattctcccacctcagcttccagagcagctgggattacagggctgcttcgaacacatcggccacgccatcgacagctacacgtggggtatctcgtggtttgggtttgccatcctgatgtggacgctcccggtcatgctgatagccatgtatttctacaccatgctctgagggacaggaggggaaggcaacatacacaccccggactcctccgcatcctcctcctgcttcctccgctgggcctggatggctgcctcacctctcacctcccaacgtccctagcccttacgtccttccacttccaagatctttttccaggttcctgagccctactgtgtctcaggtgtgccctgaaaccccagggcttgtgtgcacatatccttagcccatctttcaagggacctctccatgatcccacctcccattcacagatacctctcttgtagctctctgacctcctccttcatggcaggcatcgccattcttgctgaaccgtttgtgattgccatttgagctctggaagcctctattgccatgagagttctgtcacggtcactttactgtccccatcatcacccagcacggggctaagcatatactagatagtcaataaataa

SEQ ID NO: 33942 - DNA, 2118 bp, Homo sapiens
atcacagactacccttccctggtcctggaggttcaaagaattgcaggagggtagaaaagcacctgggtcgggtgcagactgcggagcgggccctaccgtgtgcgcagaaagaggaggcgcttgccttcagcttgtgggaaatcccgaagatggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactttttgggttctcctgggtaccatgttctactggagcagaattgaatattaagcataaagtgttgccaccatacctccttccccgagtgactctggatttggtgctggaaccagctctctcctaatattccacgtttgtgccccacactaacgtgtgtgtcttacattgccaagtcagatggtacggacttcctttaggatctcaggcttctgcagttctcatgactcctacttttcatcctagtctagcattctgcaacatttatatagactgttgaaaggagaatttgaaaaatgcataataactacttccatccctgcttatttttaatttgggaaaataaatacattcgaaggaacctgtgttatcacagtaacccagagctgtatttggctagcaatctgcctgtatctctcactattatctaaaagaaaccttccaatgcttctgttgatctcagtattgtcaggggaacagagaagttgggaaaagattactgaaatataccttttgcatttctttctagagtagctcccatatatggagatgggtgattctcttgatgccaccttcagatccttttattctccagaataattcttaacagtggttcaaatttcctttcataccttgaagtatgtgtttagtagcctcaattctccattaattaaaagtgtgggctgggcgtgggggctcatgcctgtaatcccagcactttgggaggccgaggtgggcagatcacctgaggtcaggagttcaagaccagcctggccaacatggtgaaaccccgtctctacaaaaatacaaaaattagccaggcgtgatggcaggtgcctgtaatcctagctacttggcaggctaacgcaggagaatcacttgaccgggagacagaggttgcagtgagctgagatcgtacctattgcactccatcctggatgaaagagccagactctgtctcaaaacaaacaaaaaagcgtggggacttctggggacagacaaggtgcctgttatatatttactcagtctttgccctgaatggtctcagcttgagaccatttcaaactggagagaagcaagccagccaatagaatggggtgatttacagggatttctgtttactgtcaaaatatttctcatctgcactatgtttccatttgtggtcctgaaggaaattcttataactcaacatttgtctggtcttataagtaaagacagctttaaaatctgttcactttca

SEQ ID NO: 33943 - DNA, 687 bp, Homo sapiens
ggagcgggccctaccgtgtgcgcagaaagaggaggcgctggacttatcctaccttaagttgaagcagaccagcaattgttgtgacctacaatctccacacccatctttactctgagccaaggaagtgtctgttcttgtgctgagtttcaggtgccttcagcttgtgggaaatcccgaagatggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaa

SEQ ID NO: 33944 - DNA, 670 bp, Homo sapiens
ggagcgggccctaccgtgtgcgcagaaagaggaggcgctaaactgtagcagttatttggtaatgctttcaacagtgccttcagcttgtgggaaatcccgaagatggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaat

SEQ ID NO: 33945 - DNA, 916 bp, Homo sapiens
agcctgccagcacctattccacctcccagcccagcatggcacccctgctgcccatccggaccttgcccttgatcctgattctgctggctctgctgtccccaggggctgcagacttcaacatctcaagcctctctggtctgctgtccccggcgctaacggagagcctgctggttgccttgcccccctgtcacctcacaggaggcaatgccacactgatggtccggagagccaatgacagcaaagtggtgacgtccagctttgtggtgcctccgtgccgtgggcgcagggaactggtgagtgtggtggacagtggtgctggcttcacagtcactcggctcagtgcataccaggtgacaaacctcgtgccaggaaccaaattctacatttcctacctagtgaagaaggggacagccactgagtccagcagagagatcccaatgtccacactccctcgaaggaacatggaatccattgggctgggtatggcccgcacagggggcatggtggtcatcacggtgctgctctctgtcgccatgttcctgctggtgctgggcttcatcattgccctggcactgggctcccgcaagtaaggaggtctgcccggagcagcagcttctccaggaagcccagggcaccatccagctccccagcccacctgctcccaggccccaggcctgtggctcccttggtgccctcgcctcctcctcctgccctcctctcccctagagccctctcctccctctgtccctctccttgcccccagtgcctcaccttccaacactccattattcctctcaccccactcctgtcagagttgactttcctcccattttaccactttaaacacccccataacaattcccccatccttcagtgaactaagtccctataataaaggctgaggctgcatctgcca

SEQ ID NO: 33946 - DNA, 1051 bp, Homo sapiens
ccgccccgcgctctggcggctcctcccgggcgatgcctccgctctgggccctgctggccctcggctgcctgcggttcggctcggctgtgaacctgcagccccaactggccagtgtgactttcgccaccaacaaccccacacttaccactgtggccttggaaaagcctctctgcatgtttgacagcaaagaggccctcactggcacccacgaggtctacctgtatgtcctggtcgactcagccatttccaggaatgcctcagtgcaagacagcaccaacaccccactgggctcaacgttcctacaaacagagggtgggaggacaggtccctacaaagctgtggcctttgacctgatcccctgcagtgacctgcccagcctggatgccattggggatgtgtccaaggcctcacagatcctgaatgcctacctggtcagggtgggtgccaacgggacctgcctgtgggatcccaacttccagggcctctgtaacgcacccctgtcggcagccacggagtacaggttcaagtatgtcctggtcaatatgtccacgggcttggtagaggaccagaccctgtggtcagaccccatccgcaccaaccagctcaccccatactcgacgatcgacacgtggccaggccggcggagcggaggcatgatcgtcatcacttccatcctgggctccctgcccttctttctacttgtgggttttgctggcgccattgccctcagcctcgtggacatggggagttctgatggggaaacgactcacgactcccaaatcactcaggaggctgttcccaagtcgctgggggcctcggagtcttcctacacgtccgtgaaccgggggccgccactggacagggctgaggtgtattccagcaagctccaagactgagcccagcaccacccctgggcagcagcatcctcctctctggccttgccccaggccctgcagcggtggttgtcacaccctgacttcagggaaggtgaaacagggcttgtccctccaactgcaggaaaacccttaataaaatcttctgatgagttcta

SEQ ID NO: 33947 - DNA, 627 bp, Homo sapiens
gctctggcggctcctcccgggcgatgcctccgctctgggccctgctggccctcggctgcctgcggttcggctcggctgtgaacctgcagccccaactggccagtgtgactttcgccaccaacaaccccacacttaccactgtggccttggaaaagcctctctgcatgtttgacagcaaagaggccctcactggcacccacgaggtctacctgtatgtcctggtcgactcagtcaccccatactcgacgatcgacacgtggccaggccggcggagcggaggcatgatcgtcatcacttccatcctgggctccctgcccttctttctacttgtgggttttgctggcgccattgccctcagcctcgtggacatggggagttctgatggggaaacgactcacgactcccaaatcactcaggaggctgttcccaagtcgctgggggcctcggagtcttcctacacgtccgtgaaccgggggccgccactggacagggctgaggtgtattccagcaagctccaagactgagcccagcaccacccctgggcagcagcatcctcctctctggccttgccccaggccctgcagcggtggttgtcacaccctgacttcagggaaggtgaaacagggc

SEQ ID NO: 33948 - DNA, 1296 bp, Homo sapiens
tttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccggtgggctgcaagcctggcctggaccccctccccagcctcagcccctagcctggcctctttgcatggggctgggggagatggggcgctgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctgg

SEQ ID NO: 33949 - DNA, 1308 bp, Homo sapiens
cagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccggtgggctgcaagcctggcctggaccccctccccagcctcagcccctagcctggcctctttgcatggggctgggggagatggggcgctgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctgg

SEQ ID NO: 33950 - DNA, 1608 bp, Homo sapiens
cagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccggtgggctgcaagcctggcctggaccccctccccagcctcagcccctagcctggcctctttgcatggggctgggggagatggggcgctgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttc

SEQ ID NO: 33951 - DNA, 1523 bp, Homo sapiens
cagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccggtgggctgcaagcctggcctggaccccctccccagcctcagcccctagcctggcctctttgcatggggctgggggagatggggcgctgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttc

SEQ ID NO: 33952 - DNA, 1605 bp, Homo sapiens
cagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccggtgggctgcaagcctggcctggaccccctccccagcctcagcccctagcctggcctctttgcatggggctgggggagatggggcgctgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggtctcgtgatattgagtgagcgcttgtgggatctggttgtttaaaagcatgcagccctcccacttcactctctctgtctctcctgctccaacatggccagacgtgcctgcttccccttcgccttctgccgtgattgtcagtttcctgaggcctccccagccatgcttcctgtacagcctgcagaactgtgagtcaattaaacctcttttcttc

SEQ ID NO: 33953 - DNA, 1300 bp, Homo sapiens
tgatcttcaacatggcgacgctcttggttccctacagaaaggggcggagcctggactggggggcaggctcagattcaggttaaattgtggattgagctcgcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 33954 - DNA, 1128 bp, Homo sapiens
agacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttg

SEQ ID NO: 33955 - DNA, 1079 bp, Homo sapiens
agacagctgaccatggaagcgaatgggttgggcctccagcgtagcatactgacacctacccccacccccacctgatcgccagacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttg

SEQ ID NO: 33956 - DNA, 682 bp, Homo sapiens
acctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggcccca

SEQ ID NO: 33957 - DNA, 600 bp, Homo sapiens
gcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgc

SEQ ID NO: 33958 - DNA, 744 bp, Homo sapiens
accgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagtaagtagaaaaacatcactccaaatgaagccatttattttttgttgacctcacaaccactacctagggaaaagaatatttcctcagtgcattcttggtggtgagattgattggtgagcatcgtataacccactctgggagcatagcctatttgtatttgtgtatgtctatactttgtgaggtttagcccacttccttctaccccctgtaccaaagaacttgacttgaacataacacaaaataaaacatttgggagataaaaa

SEQ ID NO: 33959 - DNA, 1556 bp, Homo sapiens
ctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagtgaagaagtcaaaggaatcttttgaagtgaagaaagtgggtttggacgtgcccttatgctgatgaatcattggagtaatatctggggtttagccgcatccttggtggcaaggcggtggggaaagcccctgagggtgaggccagcctgagccccaagggaaaggggctgctgggacctcctgacctcaactcatctccaggagcgcacagggcctcgcacagatgcctcagtctgtaccgctgggagttcgtgccatctcagacctaccctccctacctgggctgtacctaaagagatactgctaggctttctctagaatgtttcatgagccagcactgtgagacattttcaagctaaaaacatacagttcaggagactgtaatctgtggtagaaagtgttcaccatttgctgctagtaaagacggttggccctgtgcttctctggccacttgtgccacatggtgttctcggaagaggcctctccatgcaccagtgtggagaagccctctggaggccaattcaaagagcatctgaggctaagcaactgaaaggaaaaggcctgatggccaacgtgttgctttctgtggaatgttccagactggattgctgggggtcattttctttaacagcagcctagacaggcagtgactctcttttattcagccaggtgttgaaatagctgcagggaagccacagacagttgttccagctttccggatcagagagcactggttgggccccgtgccatgtggccccagccccatgggatcgctcctcaggtcatggagccacacatcagtgtggagggttcgctccaggggttcctggtacaggatgcagatgggtcttgtctggctccaggctttttgtttctaatgttgtttctagagagtcatcatcaccgcataaatggtatcaaagcccttcttttaaaaatgtagaaataaatgtaaatggtagatcttga

SEQ ID NO: 33960 - DNA, 1216 bp, Homo sapiens
ttccacaagcatttgattgccttcttcttgtgtaccgtccccatcggaaattgcttaggaagagtctttgagatctaattaagatctgtttccttgctctgtcgcagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtgctt

SEQ ID NO: 33961 - DNA, 1313 bp, Homo sapiens
cccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtgcttactga

SEQ ID NO: 33962 - DNA, 802 bp, Homo sapiens
gcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcaggctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtg

SEQ ID NO: 33963 - DNA, 2700 bp, Homo sapiens
atggaccgaaaagtggcccgagaattccggcataaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtcttttggatggttttatcgttacgatggcaaattcccaaccatccggaagaaaggaaaagataagaagaaagccaagtatggcagcctgcaggacttgagaaagaataagaaagaactggagtttgagcaaaagctttacaaagagaaagaggaaatgctggagaaggaaaagcagctaaagatcaaccggctggcccaggaggtgtctgagacagagcgggaagaccttgaagaatcggaaaagattcaatattgggtggagaggctctgtcaaacgcgcctcgagcagatttcctctgctgataatgagatttcagagatgaccacagggcccccgcctcccccgccttctgtgtctcccctggccccacccttgagacgcttcgcaggcggactgcacctgcacaccactgacctggacgacatccctttggacatgttctactatccccccaagactccctctgccttgcctgtgatgccccaccctccaccctccaacccaccccacaaggtcccggcgccccctgtccttcccttatctggccatgtgagcgcctcatcctctccatgggtgcagcgcactccaccccccattcccatccctcccccgccatccgttcccacccaagacctcactcccacccgcccactgccctcggcgctggaagaagcactgagcaaccatcccttccgcactggggacacaggcaatccagtggaggactgggaggcaaagaaccacagtgggaagcccactaactcccctgtccctgaacagagcttcccacccaccccaaagacattttgcccaagcccacagcctccacgaggccctggcgtgtccaccatctccaaacctgtcatggtccaccaggagcccaatttcatctacaggccagctgtgaaatctgaagttctgccacaggagatgttgaagaggatggtggtttatcagacagcattcagacaagatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgaggctgccctgcagaaggcctggaatcagggcggggactggatcgaccttgtggttgccgtctgccccccaaaggagtatgacgatgagctagcttctcttccctcctccgtagctgaaagcccccaaccggtccgaaagctccttgaagaccgtgctgccgtgcacagacacgggttcctcctgcagctggagcccacggaccttcttctgaagtccaaaaggggaaaccaaattcaccgttag

SEQ ID NO: 33964 - DNA, 2237 bp, Homo sapiens
agctccgagggcggctggcccggtcgcggtcgcggctctttccagctcctggcagccgggcacccgaaggaacgggtcgtgcaacgacgcagctggacctggcccagccatggaccgaaaagtggcccgagaattccggcataaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgaggctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggatcagccttgagagaggccacactacacacaccagatggcatccttgggacctgaatctatcacccaggaatctcaaactccctttggccctgaaccagggccagataaggaacagctcgggccactcttctgaaggccaacgtggaggaaagggagcagccagccatttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaatagatttattttccagctta

SEQ ID NO: 33965 - DNA, 2159 bp, Homo sapiens
ggcccggtcgcggtcgcggctctttccagctcctggcagccgggcacccgaaggaacgggtcgtgcaacgacgcagctggacctggcccagccatggaccgaaaagtggcccgagaattccggcataaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggagggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgaggctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggatcagccttgagagaggccacactacacacaccagatggcatccttgggacctgaatctatcacccaggaatctcaaactccctttggccctgaaccagggccagataaggaacagctcgggccactcttctgaaggccaacgtggaggaaagggagcagccagccatttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaatagatttattttcca

SEQ ID NO: 33966 - DNA, 2278 bp, Homo sapiens
gtggtctgcataggtctgatgcattggggtcagaggggcagcctggcctgtggctcctcttctctcctcacaactccagccctgaaaagctgctggggaggcccttggggatgacctctcctccctgaggtctgctatgggggcgggtgctgagcctggagctgtgattctgctattggattttccaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgaggctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggatcagccttgagagaggccacactacacacaccagatggcatccttgggacctgaatctatcacccaggaatctcaaactccctttggccctgaaccagggccagataaggaacagctcgggccactcttctgaaggccaacgtggaggaaagggagcagccagccatttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaatagatttattttccagct

SEQ ID NO: 33967 - DNA, 2450 bp, Homo sapiens
agcccaggcctgaacaggcagtggtcagagtgaccccaacagagtgtcccgggactcaggcctctgatcaagttacccccagaggatcagagaggggttgacgaaggagaagcattcagagggcactggcttctggacagcaatgagtgcccgggccacgcggccccgaagccggcgagggaggcatgctccacccggtgaactggatcccgtggctgagagttcagaggaggtcgaggcagccagtgggagctccaagcccagctttgccccacctccggtgagctccgggctggagcagctgggccccatggaggaggtcagtggccaaggcctaggaagcaggactgacaagaagatggatgggggctctggcagggaactggcctcagcccccgaagtgccccacaaacctgcagtggaagcccaccaagccccagaagcagccctacagtacaaggagactgtgccccctgggaatggggcccccgatgtgtttcagaccctccagcacactctgagctccctggaggcagcggctgcagcctggcgccaccagccccccagccattctgggccgatggagttcgaaggcacaagcgaagggggagcaggttcccttgggaagcaggaaggggcagggagctgccagcgagaggcagctcgcctggccgagaggaatgcctggctccggctggccctgagtagccgagaggatgagctggtccgcacgcaggcctccctggaggccatccgagctgagaaggagacgctgcagaaagaggttcaagagctgcaggattccctcttgaggctggagccctgcccacatctttcccacaaccaagcaggtggctcaggcagtggttctagcagctctgaggcagacagggaaccctgggagactcaggactccttctccctggctcaccccctgcttcggcgcctccgcagccattccagcacccagatccttgggtctcttcccaaccagcccctcagtcctgagatgcacatcatggaagcccagatggagcaactccgggggagcattgagaagctcaaatgctttaatcgtctgctatcagctgtgctacagggatacaagggccgctgtgaaggcctcagcatgcagctaggccagcgggaggctgaggccacagcattgcatctggccttgcagtacagtgaacactgtgaagaggcatacagggttctgcttgctctgcgggaggccgactcaggagcaggagacgaagcccccatgagtgacctgcaagcagctgaaaaggaagcatggaggctgctggcacaagaggaggctgccatggatgcaggagcacagcagaatccacagccaagccctgaaggcagcagtgtggataagcccaccccacaggaagtggctttccagctccgaagctatgtccagcgtctccaggagcgccgttctctaatgaagattctctcagagcctggccccaccttggcacccatgcccactgtgccccgtgcagaagccatggtgcaggccattctggggacccaggctggcccagctcttccccgactggagaagacacaaattcagcaggacctggtggccgcaagggaggccctggcggacctgatgcttcggctgcagctggtgcggcgtgagaagcggggcctagagctgcgggaggctgccctccgagccctgggtccagctcacgtgctcctgctggagcagctgcggtgggaacgggcagagctccaggctggtggggcaaacagcagtggcggacatagcagcggaggtggcagcagcggggacgaggaagagtggtatcagggccttcctgctgtccctggtggcaccagtggcattgatggtggccaggtgggcagagcctgggacccagagaagttagcccaggaactggcagcatcgctcaccaggacactggacctgcaggagcagctgcagtctctgcgcagggagctggaacaggtggctcagaaggggcgagccagacggtctcagagtgccgagctgaacagggatttatgcaaagcccacagcgccctggtcctggccttccgaggagcccaccggaagcaggaagagcaacgccggaagttggagcagcagatggcactcatggaggctcagcaggccgaggaggtggcggtgctcgaagccactgcaagggccctggggaagcccaggcctcccctcccgcctccccagcttggggacacctttctgtaggccccttacccagccatgtctggacatgccagacagctgtggcatgtcataaactgtcctggagtgacatcatgtcatgttgcatgatttggcatgttggggcacatttggcgtgagggaagctggtgcacatgggtgtccagggcctgatggggtgtggccaggcaatgaagaaagactcaggtgtctttggcct

SEQ ID NO: 33968 - DNA, 2402 bp, Homo sapiens
caacagagtgtcccgggactcaggcctctgatcaagttacccccagaggatcagagaggggttgacgaaggagaagcattcagagggcactggcttctggacagcaatgagtgcccgggccacgcggccccgaagccggcgagggaggcatgctccacccggtgaactggatcccgtggctgagagttcagaggaggtcgaggcagccagtgggagctccaagcccagctttgccccacctccggtgagctccgggctggagcagctgggccccatggaggaggtcagtggccaaggcctaggaagcaggactgacaagaagatggatgggggctctggcagggaactggcctcagcccccgaagtgccccacaaacctgcagtggaagcccaccaagccccagaagcagccctacagtacaaggagactgtgccccctgggaatggggcccccgatgtgtttcagaccctccagcacactctgagctccctggaggcagcggctgcagcctggcgccaccagccccccagccattctgggccgatggagttcgaaggcacaagcgaagggggagcaggttcccttgggaagcaggaaggggcagggagctgccagcgagaggcagctcgcctggccgagaggaatgcctggctccggctggccctgagtagccgagaggatgagctggtccgcacgcaggcctccctggaggccatccgagctgagaaggagacgctgcagaaagaggttcaagagctgcaggattccctcttgaggctggagccctgcccacatctttcccacaaccaagcaggtggctcaggcagtggttctagcagctctgaggcagacagggaaccctgggagactcaggactccttctccctggctcaccccctgcttcggcgcctccgcagccattccagcacccagatccttgggtctcttcccaaccagcccctcagtcctgagatgcacatcatggaagcccagatggagcaactccgggggagcattgagaagctcaaatgctttaatcgtctgctatcagctgtgctacagggatacaagggccgctgtgaaggcctcagcatgcagctaggccagcgggaggctgaggccacagcattgcatctggccttgcagtacagagtcttgctctgtcacccaggctggagtgcagtggtgccatcttggctcactgcaacctccgcctccccagttcaagtgattctcctgcctcagcctcctgagtagctggaactacagtgaacactgtgaagaggcatacagggttctgcttgctctgcgggaggccgactcaggagcaggagacgaagcccccatgagtgacctgcaagcagctgaaaaggaagcatggaggctgctggcacaagaggaggctgccatggatgcaggagcacagcagaatccacagccaagccctgaaggcagcagtgtggataagcccaccccacaggaagtggctttccagctccgaagctatgtccagcgtctccaggagcgccgttctctaatgaagattctctcagagcctggccccaccttggcacccatgcccactgtgccccgtgcagaagccatggtgcaggccattctggggacccaggctggcccagctcttccccgactggagaagacacaaattcagcaggacctggtggccgcaagggaggccctggcggacctgatgcttcggctgcagctggtgcggcgtgagaagcggggcctagagctgcgggaggctgccctccgagccctgggtccagctcacgtgctcctgctggagcagctgcggtgggaacgggcagagctccaggctggtggggcaaacagcagtggcggacatagcagcggaggtggcagcagcggggacgaggaagagtggtatcagggccttcctgctgtccctggtggcaccagtggcattgatggtggccaggtgggcagagcctgggacccagagaagttagcccaggaactggcagcatcgctcaccaggacactggacctgcaggagcagctgcagtctctgcgcagggagctggaacaggtggctcagaaggggcgagccagacggtctcagagtgccgagctgaacagggatttatgcaaagcccacagcgccctggtcctggccttccgaggagcccaccggaagcaggaagagcaacgccggaagttggagcagcagatggcactcatggaggctcagcaggccgaggaggtggcggtgctcgaagccactgcaagggccctggggaagcccaggcctcccctcccgcctccccagcttggggacacctttctgtaggccccttacccagccatgtctggacatgccagacagctgtggcatgtcataaactgtcctggagtg

SEQ ID NO: 33969 - DNA, 2136 bp, Homo sapiens
agagtgtcccgggactcaggcctctgatcaagttacccccagaggatcagagaggggttgacgaaggagaagcattcagagggcactggcttctggacagcaatgagtgcccgggccacgcggccccgaagccggcgagggaggcatgctccacccgactgacaagaagatggatgggggctctggcagggaactggcctcagcccccgaagtgccccacaaacctgcagtggaagcccaccaagccccagaagcagccctacagtacaaggagactgtgccccctgggaatggggcccccgatgtgtttcagaccctccagcacactctgagctccctggaggcagcggctgcagcctggcgccaccagccccccagccattctgggccgatggagttcgaaggcacaagcgaagggggagcaggttcccttgggaagcaggaaggggcagggagctgccagcgagaggcagctcgcctggccgagaggaatgcctggctccggctggccctgagtagccgagaggatgagctggtccgcacgcaggcctccctggaggccatccgagctgagaaggagacgctgcagaaagaggttcaagagctgcaggattccctcttgaggctggagccctgcccacatctttcccacaaccaagcaggtggctcaggcagtggttctagcagctctgaggcagacagggaaccctgggagactcaggactccttctccctggctcaccccctgcttcggcgcctccgcagccattccagcacccagatccttgggtctcttcccaaccagcccctcagtcctgagatgcacatcatggaagcccagatggagcaactccgggggagcattgagaagctcaaatgctttaatcgtctgctatcagctgtgctacagggatacaagggccgctgtgaaggcctcagcatgcagctaggccagcgggaggctgaggccacagcattgcatctggccttgcagtacagtgaacactgtgaagaggcatacagggttctgcttgctctgcgggaggccgactcaggagcaggagacgaagcccccatgagtgacctgcaagcagctgaaaaggaagcatggaggctgctggcacaagaggaggctgccatggatgcaggagcacagcagaatccacagccaagccctgaaggcagcagtgtggataagcccaccccacaggaagtggctttccagctccgaagctatgtccagcgtctccaggagcgccgttctctaatgaagattctctcagagcctggccccaccttggcacccatgcccactgtgccccgtgcagaagccatggtgcaggccattctggggacccaggctggcccagctcttccccgactggagaagacacaaattcagcaggacctggtggccgcaagggaggccctggcggacctgatgcttcggctgcagctggtgcggcgtgagaagcggggcctagagctgcgggaggctgccctccgagccctgggtccagctcacgtgctcctgctggagcagctgcggtgggaacgggcagagctccaggctggtggggcaaacagcagtggcggacatagcagcggaggtggcagcagcggggacgaggaagagtggtatcagggccttcctgctgtccctggtggcaccagtggcattgatggtggccaggtgggcagagcctgggacccagagaagttagcccaggaactggcagcatcgctcaccaggacactggacctgcaggagcagctgcagtctctgcgcagggagctggaacaggtggctcagaaggggcgagccagacggtctcagagtgccgagctgaacagggatttatgcaaagcccacagcgccctggtcctggccttccgaggagcccaccggaagcaggaagagcaacgccggaagttggagcagcagatggcactcatggaggctcagcaggccgaggaggtggcggtgctcgaagccactgcaagggccctggggaagcccaggcctcccctcccgcctccccagcttggggacacctttctgtaggccccttacccagccatgtctggacatgccagacagctgtggcatgtcataaactgtcctggagtgacatc

SEQ ID NO: 33970 - DNA, 3561 bp, Homo sapiens
cagatgtcttggtagtcgcggctctggcgctccgcaccctccgtctgcggcagcgggggctggcggccccggcccctgcccggccccgtcctccaacctcatgcctcagccctaataccgccgccctcccctgcggggggcctttctccgtgtcccccgcccgccccgtccacttcgggcgccatgaacgaccagtaccaccgggcagcccgggatggctacctggagctcctcaaggaggccacccgaaaggagctgaatgcccccgacgaggatggcatgacccccactctctgggctgcctaccatggcaacctcgagtcgctgcgtctcattgtgagccgcgggggtgacccggacaagtgtgacatctggggcaacacacccctgcatctggcagcttccaatggccacttgcactgcctgtccttcctggtgtccttcggagccaacatctggtgcctagacaacgactaccacacgccgctggacatggctgccatgaagggccacatggaatgcgtgcgctacctggactccatcgcggccaagcagagcagcctcaaccccaagctggtgggtaagctgaaggacaaggccttccgcgaggcggagcggcgcatccgcgagtgcgccaagctgcagcggaggcaccacgaacgcatggagcggcgataccggcgcgagctggccgagcgttccgacaccctcagcttctccagcctcacgtccagcaccctgagccgccggctgcagcatctggcgctgggcagccacctgccgtactctcaggccacgctgcacggcacggccaggggcaagaccaagatgcagaagaagctggagcggcgcaagcagggcggcgaaggcaccttcaaggtctccgaggatgggcgcaagagcgcccgctcgctctcgggcctgcagctgggcagcgacgtgatgttcgtgcgccagggcacctacgccaatcccaaggagtggggccgagccccgctccgggacatgttcctctcggacgaggacagcgtctcccgtgccacgctggcggccgagcctgcccactcggaggtcagcaccgactcaggccacgactccctgtttacccgccccggcctgggcaccatggtgttccgcagaaattacttgagcagtgggctgcacggactgggccgcgaggatgggggtctggatggggtgggagcgccgcggggtcggctgcagagctcccccagcctggacgatgacagcctgggcagtgccaacagcctgcaggaccgcagctgtggggaggagctgccctgggatgagctcgatttaggcttggacgaggacctggagcccgagactagcccgctggagaccttcctggcctctctgcacatggaggactttgccgccctcctgcggcaggagaagatcgacctcgaggctttgatgctgtgctctgacctcgacctccgcagcatcagcgtcccactggggccccgaaagaagatcttgggggccgtgaggaggcggcggcaggcgatggagcgcccgccggccctggaggacacagagctataaccgggggctcctctccccagaccaaaatgaattgcaagttgccacaacctatggtggggtctcgaggtcctcacagttgccagccctgcagcccccttccccaggagcaaggaccagttggggcgactcctttgaaagtctgtctgcaccttgaagctgagggtgtggcctggaggcaccagaggggcaagagaatgttccggaactccagttctgaggggtcttgaaggccctgagccacccattctgagcagccgtaaaggacatgtagacttgggggaggcctgccccagagggagggcaggggcatcggaactggatgagagtgtgggaggtggatgcgggagggtgcacctgtcccgggcgccgtaggcctctcccacccctcccctgatggtcttgttctcttgtgctcaggccagagacttgctcacttcctgcattgttgtgaagggaagagtttgggctgcctcccctcctcccgtccaccccagaggggaagttcctcagccagactcttcagccaaatgccccaactttcagtctgtaccccatcccaagcatagccagctccccctccttcacctagtggtcaaggcccggagctggaaagccgggttggggtggggtgggggtactgacgcccttcccagctcatccaggggtggagcctggcctgtcttcctccaacctccccctttttcgttgtgcagcctggccccccagggaccccagagggccagggcgctagatgcaaggtgctagaccaatgggctgcagtattatagcccccaggcctggcaggcatgcgctgggctagagaaaggtgtccgccaacctcctcagtctcccaggcctgggacaggcagaacagggtgtggctgggtgtcaggcctggggtgggtaagtcctgcgatgtggacactggagaaagtggatcctctaaactgcagattgtccccaggtcaccagggctgtgtgcgtgtgcatgtttgtgtgcatgtatgcgtgtgtgcatgcatgtgtgtgtaagtatgtggtatgtgtgagcacgggtgtgtgcttgggtgtgtgtgtgttcttgcatacatgtgtacgtgtgtgtgcacgtgaacgcgtgcgtgtttgtgtgtgtgcatgcatgtgtgtgcatgtgtgtgtgtgcatgcatgtgtgtgtgtgtgcatgtgtgcgtgtgtgcacactcacgttgggtggtgtttggtaggtttccctccaggtctggtagggactgggctgttgcgtgattctgcgtggatcgggggtaagagagctcacctgtgtcccagccctctgatggtggtgagaccaggggaaaggccagctcagagggtggtcacagcatgtgtcctctgacgtatgcccccaaagctctccagccagactgaggtcacagatgtgggagagtccctgatgagcccgctgacacgtgtgcgcccctttgcaccccatgcagaggtgctctcctcctttctcagccatggccccccatccctgacctcagcttgggaagcagctcctgctgggagcatggcctcagcccccagcatctcctggggcccccatggctggggcaggggaaagagagccctcaaaggcctctttctggtctgtctgggggttcccattcccacacatgtgcccagagtagggggcatggaggagatggtccctgtcctactgcaggacactgagggcttggctgcctgccaccgccatctggagcccaccacagctcttctccctgttctctgggcctgagcctggggccacccccaagtgccgacttgtttctcccagagccccaggtgctgccccttctctcctgttcctcgtccgtttactgccgcagcccctcctggttcttctggtgctggggtggagcaggctctgtgctcccaccactgtaccccgaatccctcctgcaggctcattgccacttttgtagagaatgttctctatcagtatcgt

SEQ ID NO: 33971 - DNA, 18883 bp, Homo sapiens
tgtttgctctgcagaatactttacctgggcacccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatgataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgcttttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgcatcagacaaaaatcagcttctttatcaatggcgtggagaaggatcatacacctttcaatgcaagaactctaagtggttcaattacagattttgcatctggtactgtgcaaataggacagagtttaaatggtttagagcagtttgtcggaagaatgcaagattttcgattataccaagtggcacttacaaacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaattttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggagatgtcagtgccatggtcatgccgataactgcgacacaacaagccagccatatagatgcctctgctcccaggagagcttcactgaaggacttcattgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggaaggaactgtgagctgtgcaaggattactttttccgacaagttggtgcagatccttcggccatagatgtttgcaaaccctgtgactgtgatacagttggcactagaaatggtagcattctttgtgatcagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattgggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaactccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacagctgttgcacactgctaaatcccaagaactatcttacactgtagaaggactgaaaccttataggatatatgagtttactattactctctgcaattcagttggttgtgtgaccagtgcttcgggagcaggacaaactttagcagcagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggcattaaggccagctttcgaacaaaagtgcctgaaggtttgattgtctttgcagcatcacctggcaatcaggaagagtattttgcacttcagttgaagaagggacgtctttattttctttttgatcctcaggggtcaccagtggaagtaactacaactaatgatcatggcaaacaatatagtgatggaaaatggcatgaaataattgctattaggcatcaggcttttggccaaatcactctggatgggatatatacaggttcctctgccatcctgaatggtagtactgttattggagataacacaggagtctttctgggagggctcccgcgaagttataccatcctcaggaaggatcctgagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcagggttcctggaacttcatccatatatgtttcatggtggaatgaactttgagatttcctttaagttcagaactgaccaattaaatggattgcttcttttcgtttataacaaagatggacctgattttcttgctatggagctgaaaagtggaatattgaccttccggttaaataccagtcttgcctttacacaagtggatctattgctggggctatcctattgtaatggaaagtggaataaagtcattattaaaaaggaaggctctttcatatcagcaagtgtgaatggactgatgaagcatgcatcggagtccggagaccagccactggtggtgaattcaccagtttatgtgggaggaatcccacaggaactgctgaactcttatcaacatttgtgtttggaacaaggtttcggtggttgcatgaaggatgttaaatttacacggggtgctgtcgttaacttggcatctgtgtccagcggtgctgtcagagtcaatctggatggatgcctatcaactgacagtgctgttaactgcaggggaaatgactccatcctggtttaccagggaaaagagcagagtgtttacgagggtggtctccagccttttacagaatacctgtatcgagtgatagcctcgcatgaaggaggttcagtatatagtgattggagtcgaggacgtacaacaggagcagctccacaaagtgtgccaactccctcaagagtccgcagcttaaatggatacagcattgaggtgacctgggatgaacctgttgtcagaggtgtaattgagaagtacattctgaaagcctatagtgaggacagcacccgtccaccccgcatgccctctgccagtgctgaatttgtcaatacaagcaacctcacaggcatattgacaggcttgctacccttcaaaaactatgcagtaaccctaactgcttgcactttggctggctgtactgagagctcacatgcattgaacatctctactccacaagaagccccacaagaggttcagccaccagtagccaaatcccttcccagttctttgctgctctcctggaacccacccaaaaaggcaaatggtattataactcagtactgtttatacatggatgggaggctgatctattcaggcagtgaggagaactacatagtcacagatttagcagtatttacaccccaccagtttctactaagtgcatgcacacatgtgggctgtacaaacagttcctgggtcctactgtacacagcacagctgccaccagaacacgtggattccccagttctgactgtcctggattctagaactatacacatacagtggaaacaaccaagaaaaataagtgggattctggaacgctatgtattatatatgtcaaaccatacacatgattttacaatttggagtgtcatctataacagtacagaacttttccaggatcatatgctacaatacgttttacctggtaataaatatctcatcaagctgggagcttgcacaggtggtgggtgcacagtgagtgaggccagtgaggccctaactgacgaggacatacccgaaggcgtgccagcccccaaagcccactcatattcacctgactcctttaatgtctcctggactgagcctgaatatccgaatggtgttatcacgagttatggattatatctagatggtatattaatccacaattcctcagaactcagctatcgtgcttacggatttgctccttggagtttacattccttcagagtccaagcatgcacggccaaaggttgtgctctgggcccactggtggaaaatcgaactctagaagctcctcctgaaggaacagtaaatgtgtttgtcaaaacacagggatcccggaaagcccacgtgaggtgggaagcaccttttcgccctaatggactcttaacacactcagtccttttcactgggatattctatgtagacccagtaggtaataactacacccttctgaatgtcacaaaagtcatgtacagcggagaagagacaaacctttgggtgctcatcgatgggctggttccttttaccaactatactgtacaagtgaatatttcaaatagccaaggcagcttgataactgatcctataacaattgcaatgcctccaggagctccagatggcgtgctgcctcccaggctttcatctgccactccaaccagtcttcaggttgtctggtctacaccagctcgtaataacgctcctggctctcccagataccaactccagatgaggtctggcgactccacccatggatttctagagttattttccaatccttctgcatcgttaagctatgaagtgagtgatctccaaccgtacacagagtatatgtttcggttggttgcctccaatggatttggcagtgcacatagttcttggattccattcatgaccgcagaggacaaacctggacctgtagttcctccgattcttctggatgtgaagtcaagaatgatgttggtcacctggcagcatcctagaaaatccaatggggttattacccattataacatttatctacatggccgtctatacttgagaactcctggaaatgtcactaattgcacagtgatgcatttacacccatacactgcctataagtttcaggtagaagcctgcacttcaaaaggatgttccctttcaccagagtcccagactgtatggacactcccaggggcaccggaagggatcccaagtccagagctgttctctgatactccaacatctgtgattatatcttggcaaccccctacccaccccaatggcttggtggagaatttcacaattgagagaagagtcaaaggaaaggaagaagttactaccctggtgactctcccgaggagtcattccatgaggtttattgacaagacttctgctcttagcccatggacaaaatatgaatatcgggtactgatgagcactcttcatggaggcacaaacagcagtgcttgggtagaagttaccacaagaccctcacgacctgctggggtgcagccacctgtggtgacagtgctggaacccgatgcagtccaggtcacttggaaacccccactcatccagaacggagacatacttagctatgagattcacatgcctgaccctcacatcactttaaccaatgtgacttccgcagtgttaagtcaaaaagttactcatctgattcctttcactaattattctgtcaccattgttgcttgctcagggggtaatgggtaccttggagggtgcacagagagtttacctacctatgttaccactcaccccaccgtacctcagaatgttggcccattgtctgtgattccactaagtgaatcatatgttgtgatttcttggcaaccaccatccaagccaaatggacctaatttgagatatgagcttctgagacgtaaaatccagcagccacttgcatcaaatcccccagaagatttaaatcggtggcacaatatttattcaggaactcagtggctttatgaagataagggtcttagcaggtttacaacctatgaatatatgctcttcgtacacaacagtgtgggttttacaccgagccgagaagtgactgtgacaacgttagctggtcttccagagagaggagccaatctcactgcgagtgtccttaaccacacagccatcgacgtgaggtgggctaaaccaactgttcaagacctacaaggtgaagttgaatattacacacttttttggagttctgctacctcaaacgactctctaaaaatcttgccagatgtaaactctcatgtcattggccacctaaagccaaacacagagtattggatctttatctctgtcttcaatggagtccacagcatcaacagtgcaggacttcatgcaaccacttgcgatggggagcctcagggcatgcttcctccagaggttgtcatcatcaacagtacagctgtacgtgtcatctggacatctccttcaaacccaaatggtgttgtcactgagtattctatctatgtaaataataagctctacaagactggaatgaatgtgcctgggtcgtttattctgagagacctgtctcccttcactatctatgacattcaggttgaagtctgcacaatatatgcctgcgtgaaaagcaatggaacccaaattaccactgtggaagacactccaagtgatataccaacacccacaattcgtggcatcacttcaagatctcttcaaattgattgggtgtctccacggaagccaaatggcatcattcttggatatgatctcctatggaaaacatggtatccatgcgctaaaactcaaaagttagtgcaggatcagagtgatgagctctgcaaggcagtgaggtgtcaaaaacctgaatctatctgtggacacatttgctattcttctgaagctaaggtttgttgtaacggagtgctctataaccccaagcctggacatcgctgttgtgaagaaaagtatatcccgtttgttctgaattctactggagtttgttgtggtggccgaatacaggaggcacaaccaaatcatcagtgctgctctgggtattacgctagaattctaccaggtgaagtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccaggtatgttctgttgtgggcaggattatgtgaatatgtcagataccatatgctgctcagcttccagtggagagtctaaagcacatattaaaaagaatgacccggtgccagtaaaatgctgtgagactgaacttattccaaagagccagaaatgctgtaatggagttggatataatcctttgaaatatgtttgctctgacaagatttcaactggaatgatgatgaaggaaaccaaagagtgcaggatcctctgcccagcatctatggaagccacagaacattgtggcaggtgtgacttcaactttaccagccacatttgcactgtgataagagggtctcacaattccacagggaaggcatcaattgaagaaatgtgttcatctgccgaagaaaccattcatacagggagtgtaaacacgtactcttacacagatgtgaacctcaagccctacatgacatatgagtacaggatttctgcctggaacagctatgggcgaggactcagcaaagctgtgagagccagaacaaaagaagatgtgcctcaaggagtgagtccccctacgtggaccaaaatagacaatcttgaagatacaattgtcttaaactggagaaaacctatacaatcaaatggtcctattatttactacatccttcttcgaaatggaattgaacgttttcggggaacatcactgagcttctctgataaagagggaattcaaccatttcaggaatattcatatcagctgaaagcttgcacggttgctggctgtgccaccagtagcaaggtagttgcagctactacccaaggagttccggagagcatcctgccaccaagcatcacagccctaagtgcagtggctctgcatctgagctggagtgtccctgagaaatcaaacggcgtcattaaagagtaccagatcaggcaggttgggaaaggtctcatccacactgacaccactgacaggagacagcatacggtcacaggtctccagccatacaccaactacagcttcactcttacagcttgtacatctgctgggtgcacttcaagcgagccttttctaggtcagacactgcaggcagctcctgaaggagtttgggtgacacctcgacacattatcatcaattctacaacagtggaattatattggagtctgccagaaaagcccaatggcctcgtttctcaatatcaattgagtcgtaatggaaacttgcttttcctgggtggcagtgaggagcagaatttcactgataaaaacctggagcccaatagcagatacacttacaagttagaagtcaaaactggaggtggcagcagtgctagtgatgattacattgttcaaacacctatgtcaacaccagaagaaatctatcctccatataatatcacagtaattgggccttattctatatttgtagcttggataccaccagggatcctcatccccgaaattcctgtggagtacaatgtcttactcaatgatggaagtgtaacacctctggccttctccgttggtcatcatcaatccacccttctggaaaatttgactccattcacacagtatgagataaggatacaagcatgtcaaaatggaagttgtggagttagcagtaggatgtttgtcaaaacacctgaagcagccccaatggatcttaattctcctgttcttaaggcactggggtcagcttgcatagagattaagtggatgccacctgaaaaaccaaatggaatcatcatcaactactttatttacagacgccctgctggcattgaagaggagtctgttttatttgtctggtcagaaggagcccttgaatttatggatgaaggagacaccctgaggcctttcacactctacgaatatcgggtcagagcctgtaactccaagggttcagtggagagtctgtggtcattaacacaaactctggaagctccacctcaagattttccagctccttgggctcaagccacgagtgctcattcagttctgttgaattggacaaagccagaatctcccaatggcattatctcccattaccgtgtggtctaccaggagagacccgacgatcctacatttaacagccctaccgtgcatgctttcacagtgaagggaacaagccatcaagcccacctgtacgggttagaaccattcacaacatatcgcattggtgttgtggctgcaaaccatgcaggagaaattttaagcccttggactctgattcaaaccttagaatcttccccaagtggactgagaaactttatagtagaacagaaagagaatggccgggcattgctactacagtggtcagaacctatgagaaccaatggtgtgattaagacatacaacatcttcagtgacgggttcctggagtactctggtttgaatcgtcagtttctcttccgccgcctggatcctttcactctctacacactgaccctggaggcctgcaccagagcaggttgtgcacactcggcgcctcagcctctgtggacagatgaagcccctccagactctcagctggctcctactgtccactctgtgaagtccaccagtgttgagctgagctggtctgagcctgttaacccaaatggaaaaataattcgctatgaagtgattcgcagatgcttcgagggaaaagcttggggaaatcagacaatccaggccgacgagaaaattgttttcacagaatataacactgaaaggaatacatttatgtataatgacacaggtttgcaaccatggacgcagtgtgaatataaaatctacacttggaattcagctgggcatacctgtagctcttggaatgtggtgaggacattgcaagcacctccagaaggtctctctccacctgtgatatcctatgtttctatgaatccccaaaaactgctgatttcctggatcccaccagaacagtctaatggtattatccagtcctataggcttcaaaggaatgaaatgctctatccttttagctttgatcctgtgactttcaattacactgatgaagagcttcttcctttttccacctatagctatgcactccaagcctgcacgagtggaggatgctccaccagcaaacccaccagcatcacaactctggaggctgctccatcagaagtcagccctccagatctttgggccgtcagtgccactcaaatgaatgtatgttggtcaccgcccacagtgcaaaatggaaagattactaaatatttagttagatatgataataaagagtcccttgctggccagggcctgtgcctgctggtttcccacctgcagccttactctcagtataacttctcccttgtagcctgcacgaatggaggttgcacagctagtgtgtcaaaatctgcctggacaatggaggccctgccagagaacatggactctccaacattgcaagtcacaggctcagaatcaatagaaatcacctggaaacctccaagaaacccaaatggccagatcagaagttatgaacttaggagggatggaaccattgtatatacaggcttggaaacacgctatcgtgattttactctcaccccaggtgtggagtatagctacacagtaactgccagcaacagccaagggggtattttgagtcctcttgtcaaagatcgaaccagcccctcagcaccctcagggatggaacctccaaaattgcaggccaggggtcctcaggagatcttagtgaactgggaccctccagtgagaacaaatggtgatatcatcaattataccctcttcatccgtgaactatttgaaagagaaactaaaatcatacacataaacacaactcataattcttttggtatgcagtcatatatagtaaaccagctgaagccatttcacaggtatgaaatacgaattcaagcgtgcaccaccctgggatgtgcatcaagtgactggacattcatacagacccctgagattgcacctttgatgcaaccccctccacatctggaggtacaaatggctccaggaggattccagccaactgtttctcttttgtggacaggaccgctgcagccaaatggaaaagttttgtattacgaattatacagaagacaaatagcaactcagcctagaaaatccaatccagtcctaatctataacggaagctcaacatcttttatagattccgaactattgcctttcacagagtatgagtatcaggtctgggcagtgaattctgcaggaaaagcccccagtagctggacatggtgcagaaccgggccagccccaccagaaggtctcagagcccccacgttccatgtgatctcttctacccaagcagtggtcaacatcagtgcccctgggaagcccaacgggatcgtcagtctctacaggctgttctccagcagcgcccatggggctgagacagtgctatccgaaggcatggccacccagcagactctccatggccttcaagccttcactaactactctattggagtagaggcctgcacctgcttcaactgttgcagcaaaggaccgacagctgaactgagaacccatcctgccccaccctcaggactgtcctctccacaaatcgggacgctggcctcaaggacggcctccttccggtggagtccccccatgttccccaatggtgtcattcacagctatgaactccaattccacgtggcttgccctcctgactcagccctcccctgtactcccagccaaatagaaacaaagtacacggggctggggcagaaagccagccttgggggtctccagccctacaccacatacaagctgagagtggtggcacacaacgaggtgggcagtacggcttccgagtggatcagtttcaccacccaaaaagaattgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaaccttctttttccaggtcatctgcacgactgacgaaggaagtgttaagacgccgttgatccaatatgatacctctactggacttggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatggggttagccgataccaaaattccccggtctgggacacctgtgagtatccgcagcaaccggagtgcatgtgtcctgcgcatcccgagtcaaaaccaaaccagcctaacctactcccagggttctcttcaccgcagcgtcagccagctcatggacattcaagacaagaaagtcttgatggacaactcactgtgggaagccatcatgggccacaacagtggactgtatgtggatgaagaggacctgatgaacgccatcaaggatttcagctcagtgactaaggaacgcaccacattcacagacacccacctgtaaaggatggaaacccagaagacgtaaccctggaatgcaaggtctgcacccatttcctcctgggttatcactcacacatcataaatgctgaaaagccattgtttattatcctataattctttaaagaaatgatgactgtttttgaaagtgttccttcctaatagaggtctaagaaatgatatttttctcatcttaaatgagagagaatattcatatgaaaatacttgatttgctcttattttgtagaagacaaagaagtatgtaattgtcacttggttctgtttggcagtgatgctcctggttaactgaataatcagtggcaatttcaagatggctcacagttgttagaagtagtaagttagttactggctcaaaaatgattctgttgaaaggatgtcactgctgttcatttctatctgccatttctgtcagggttgacacaatcctgcaagaatagttattctaatgatcacagctgctaaatgaatcccaaactttgcaccaggtcgacaaacttttctgaaggttctatttatttaccatacatagggttacttaccaaactttttgacaaggctgaaggttctatttatttacaatacatagggttactcaccaaactttttgacaaggcaacacataacttacacataaatgtctctgttcttgcatttatgaattttccaaaaatctaaggagtaaacagcttatttatacattttgaggagaaaacaaagtgtttcactaggaacacctctacttgaaccaatgtttttatttcatatattttatagttttgaaactagtttctcataaaattctgtcaattcactgaatatcagagaatactgacatcttcaacctagcacatttcaaatggaaactactgttctatttgcaatattaggctgcgtgaaattttaaaaggaaaaatgtatctgttccttctagcattaacatatatacatgtagagacaagactatacctatgtgtatatatatgtatatcatgtatatattactctgcactatatcccttctttttggagaactagccattattttagccacagaatcagtaagaacagatgatatgcaacagtaccaattacggttcaaaaatgtctgtcacctgctctagttggattacaaagtcattggtgaaagtcctatggcaagaaaaattttcttgcaaatcatccacataaaatcagatatttaaatttgttcttcatggaaaacagagtaagaaaacctcttgtcttccttcatccttaaaggtctttgtgaccccaggaaaatattgactctgtctaacacacaatagtcacaatactttttgtgaatctacaaccagagacaggcaaaaacttgtaaagtaagggatagtcttacttattctgcctgaaaacaatgtattaccccagggcccaacagtaaaagattgtggactttttgggtattgagatttcatctagctctgtgagagagcagctcctcagactgaccaactcctagacaaagtttgccaaccataagtgtcaaaagcacaggccagtattaagcagaagttctaccaccttattagaactgctataaacaaaagcatctgaaataattgtgcacatctggcagtgactgtagaaaatacgaaatatatatttctcgccaagtttttatactttctgaaatgaaaacataggattgactagtttactggtttttattcccatatgccgattctgggacaataaagttgtttaaagctggcacaaataagcattaaccaaggctgtgtccaccttctgtgagctacttaaggtatataggaaaggagtggtcacaaacttgcatcctaatccttggtggactcttctaagaatacagtttgctagtcacaaagaatagtctacaaatatgctttgctaggttcagaagattgagtttatcctgatttttgaaaaattaaccaggtatctttatcactgtgtatttttccaagcacagtataaaattttaacaacgcacaaaaaaatacagaactgcaggggattttatcttggatcattatccatttaatcatctaattagacatgaactcagttagctgaatcatttacattttgactccatagcttagggcagacagaagcctgtatggcttctgcccagaactctgtcccctgctacatgtctaagtttacttgtatttatttcagagaagaactctaagatgttgctttgctactttaagtggtattgcgtgccaagcctctattatacaaaccatgcagactcgcctctagagattctgattcggttgatctggggtgtgtggctgaggcatcagtactttttaaagcttccaggtgttctaatgttgagacccactgatgttccacaatctggaagaaatcatgtacaggaataatatgctatgcacagggactatgctccttggctcaccccttctcccttataaacaatgagcagttcttgatgaacctctttaaatttaaatctcctgactcacattttaccaattgtacatgccacattctcagcttacgaactaccatgttttgttattcttaatatcaactgtttggtaagagtacagttgtttttatacactctaagaaatgtgtttataatctactgtaatttccactaaatggaacccaaatattaatgttatggtaccatatactgatgtaaaaatcatgctggcatccatgaacacaccggtaaataaaacatagtccaagtggaagaattcattaataaggaacttttaattatgtcacaaatgaatagttggtttccaatgcacaaatatcatgtaaactaatctaaagatggtttgcttaataaatatttgaatgtgacc

SEQ ID NO: 33972 - DNA, 6320 bp, Homo sapiens
tgtttgctctgcagaatactttacctgggcacccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatgataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgcttttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgcatcagacaaaaatcagcttctttatcaatggcgtggagaaggatcatacacctttcaatgcaagaactctaagtggttcaattacagattttgcatctggtactgtgcaaataggacagagtttaaatggtttagagcagtttgtcggaagaatgcaagattttcgattataccaagtggcacttacaaacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaattttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggagatgtcagtgccatggtcatgccgataactgcgacacaacaagccagccatatagatgcctctgctcccaggagagcttcactgaaggacttcattgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggaaggaactgtgagctgtgcaaggattactttttccgacaagttggtgcagatccttcggccatagatgtttgcaaaccctgtgactgtgatacagttggcactagaaatggtagcattctttgtgatcagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattgggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaactccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacagctgttgcacactgctaaatcccaagaactatcttacactgtagaaggactgaaaccttataggatatatgagtttactattactctctgcaattcagttggttgtgtgaccagtgcttcgggagcaggacaaactttagcagcagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggtaagtgtgtttgacattgctttatttaggagacacgaagctccaaaatgttttctatattttcatatccctttacaatgaatttttattatacctacttagagaaatactaattcagccctttgatagcttttgcctgattgtttcagcatgtccatctttttagaattctggggaaaaaagtcaggtaagtgaaggaaaggaaaaataaaagatgaagatgaagaagcagccttattggatcaaagtatgtgctttgtatttgtctttttgtgaagtatgtgccaggacatgtttcttgaaatattattcactgtgttctctgagcaaatgagtttgcaaaatgccctcatgctattggagattctcagtatgcaccccgttactgaaactccaaaaagcattgtaagaaagctattcaactttgcttagctaatcatgcctaacagatatttgatgtaatgttttctttttctttctcttgctgtttccttcttctttttttcactgtgacaacttaatatctcatgttctatgaagaacattgtggggaaaactaatcccagggaaaagataacttctctaagccaggactatggtaaagcaagtgaggctcttgtttcggtcacaaaatttaaaggcactaaaaaactcagtgttaatgtaaattttaatgcaatatttttaaaaatgaaaatcaatgtgaaagcactataaaaatattatcaaaagcttaaataaagacagattgaactctgtaccagcacaatcctgcctcactggccttaccctcctcctggccttactagtaccgcaatattttggaagtcccatgacctctgtgacttacagcttctaatagcatgatttcaatatagctgtaaaaaaactctacttatggtacaccatttttccaatttttaaaaaaatttacaaagtataagatatatattattatgtaaactcataaagatgttcatttaatcatccatgagaaagtcattttggagcaaatagctagtctttaaaatattgcatatgtgaagacaatgaaatggaattcgagctataaaaatttgtattgttttatttttacttaaaatagtaaatagtttgcttttcattgagactggctgctgatgcaccttggtaatgaatcatgattatattctaactgagatatattgagattaatgcatgattaactactctctcagtacatcaaaatcattgcagagtattagaaattgaaccattgagctaaaaatgctcaacttctgctttatattcttaaaatggcaaaaaa

SEQ ID NO: 33973 - DNA, 18955 bp, Homo sapiens
tgtttgctctgcagaatactttacctgggcacccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatgataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgcttttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgcatcagacaaaaatcagcttctttatcaatggcgtggagaaggatcatacacctttcaatgcaagaactctaagtggttcaattacagattttgcatctggtactgtgcaaataggacagagtttaaatggtttagagcagtttgtcggaagaatgcaagattttcgattataccaagtggcacttacaaacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaattttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggagatgtcagtgccatggtcatgccgataactgcgacacaacaagccagccatatagatgcctctgctcccaggagagcttcactgaaggacttcattgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggaaggaactgtgagctgtgcaaggattactttttccgacaagttggtgcagatccttcggccatagatgtttgcaaaccctgtgactgtgatacagttggcactagaaatggtagcattctttgtgatcagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattgggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaactccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacagctgttgcacactgctaaatcccaagaactatcttacactgtagaaggactgaaaccttataggatatatgagtttactattactctctgcaattcagttggttgtgtgaccagtgcttcgggagcaggacaaactttagcagcagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggcattaaggccagctttcgaacaaaagtgcctgaaggtttgattgtctttgcagcatcacctggcaatcaggaagagtattttgcacttcagttgaagaagggacgtctttattttctttttgatcctcaggggtcaccagtggaagtaactacaactaatgatcatggcaaacaatatagtgatggaaaatggcatgaaataattgctattaggcatcaggcttttggccaaatcactctggatgggatatatacaggttcctctgccatcctgaatggtagtactgttattggagataacacaggagtctttctgggagggctcccgcgaagttataccatcctcaggaaggatcctgagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcagggttcctggaacttcatccatatatgtttcatggtggaatgaactttgagatttcctttaagttcagaactgaccaattaaatggattgcttcttttcgtttataacaaagatggacctgattttcttgctatggagctgaaaagtggaatattgaccttccggttaaataccagtcttgcctttacacaagtggatctattgctggggctatcctattgtaatggaaagtggaataaagtcattattaaaaaggaaggctctttcatatcagcaagtgtgaatggactgatgaagcatgcatcggagtccggagaccagccactggtggtgaattcaccagtttatgtgggaggaatcccacaggaactgctgaactcttatcaacatttgtgtttggaacaaggtttcggtggttgcatgaaggatgttaaatttacacggggtgctgtcgttaacttggcatctgtgtccagcggtgctgtcagagtcaatctggatggatgcctatcaactgacagtgctgttaactgcaggggaaatgactccatcctggtttaccagggaaaagagcagagtgtttacgagggtggtctccagccttttacagaatacctgtatcgagtgatagcctcgcatgaaggaggttcagtatatagtgattggagtcgaggacgtacaacaggagcagctccacaaagtgtgccaactccctcaagagtccgcagcttaaatggatacagcattgaggtgacctgggatgaacctgttgtcagaggtgtaattgagaagtacattctgaaagcctatagtgaggacagcacccgtccaccccgcatgccctctgccagtgctgaatttgtcaatacaagcaacctcacaggcatattgacaggcttgctacccttcaaaaactatgcagtaaccctaactgcttgcactttggctggctgtactgagagctcacatgcattgaacatctctactccacaagaagccccacaagaggttcagccaccagtagccaaatcccttcccagttctttgctgctctcctggaacccacccaaaaaggcaaatggtattataactcagtactgtttatacatggatgggaggctgatctattcaggcagtgaggagaactacatagtcacagatttagcagtatttacaccccaccagtttctactaagtgcatgcacacatgtgggctgtacaaacagttcctgggtcctactgtacacagcacagctgccaccagaacacgtggattccccagttctgactgtcctggattctagaactatacacatacagtggaaacaaccaagaaaaataagtgggattctggaacgctatgtattatatatgtcaaaccatacacatgattttacaatttggagtgtcatctataacagtacagaacttttccaggatcatatgctacaatacgttttacctggtaataaatatctcatcaagctgggagcttgcacaggtggtgggtgcacagtgagtgaggccagtgaggccctaactgacgaggacatacccgaaggcgtgccagcccccaaagcccactcatattcacctgactcctttaatgtctcctggactgagcctgaatatccgaatggtgttatcacgagttatggattatatctagatggtatattaatccacaattcctcagaactcagctatcgtgcttacggatttgctccttggagtttacattccttcagagtccaagcatgcacggccaaaggttgtgctctgggcccactggtggaaaatcgaactctagaagctcctcctgaaggaacagtaaatgtgtttgtcaaaacacagggatcccggaaagcccacgtgaggtgggaagcaccttttcgccctaatggactcttaacacactcagtccttttcactgggatattctatgtagacccagtaggtaataactacacccttctgaatgtcacaaaagtcatgtacagcggagaagagacaaacctttgggtgctcatcgatgggctggttccttttaccaactatactgtacaagtgaatatttcaaatagccaaggcagcttgataactgatcctataacaattgcaatgcctccaggagctccagatggcgtgctgcctcccaggctttcatctgccactccaaccagtcttcaggttgtctggtctacaccagctcgtaataacgctcctggctctcccagataccaactccagatgaggtctggcgactccacccatggatttctagagttattttccaatccttctgcatcgttaagctatgaagtgagtgatctccaaccgtacacagagtatatgtttcggttggttgcctccaatggatttggcagtgcacatagttcttggattccattcatgaccgcagaggacaaacctggacctgtagttcctccgattcttctggatgtgaagtcaagaatgatgttggtcacctggcagcatcctagaaaatccaatggggttattacccattataacatttatctacatggccgtctatacttgagaactcctggaaatgtcactaattgcacagtgatgcatttacacccatacactgcctataagtttcaggtagaagcctgcacttcaaaaggatgttccctttcaccagagtcccagactgtatggacactcccaggggcaccggaagggatcccaagtccagagctgttctctgatactccaacatctgtgattatatcttggcaaccccctacccaccccaatggcttggtggagaatttcacaattgagagaagagtcaaaggaaaggaagaagttactaccctggtgactctcccgaggagtcattccatgaggtttattgacaagacttctgctcttagcccatggacaaaatatgaatatcgggtactgatgagcactcttcatggaggcacaaacagcagtgcttgggtagaagttaccacaagaccctcacgacctgctggggtgcagccacctgtggtgacagtgctggaacccgatgcagtccaggtcacttggaaacccccactcatccagaacggagacatacttagctatgagattcacatgcctgaccctcacatcactttaaccaatgtgacttccgcagtgttaagtcaaaaagttactcatctgattcctttcactaattattctgtcaccattgttgcttgctcagggggtaatgggtaccttggagggtgcacagagagtttacctacctatgttaccactcaccccaccgtacctcagaatgttggcccattgtctgtgattccactaagtgaatcatatgttgtgatttcttggcaaccaccatccaagccaaatggacctaatttgagatatgagcttctgagacgtaaaatccagcagccacttgcatcaaatcccccagaagatttaaatcggtggcacaatatttattcaggaactcagtggctttatgaagataagggtcttagcaggtttacaacctatgaatatatgctcttcgtacacaacagtgtgggttttacaccgagccgagaagtgactgtgacaacgttagctggtcttccagagagaggagccaatctcactgcgagtgtccttaaccacacagccatcgacgtgaggtgggctaaaccaactgttcaagacctacaaggtgaagttgaatattacacacttttttggagttctgctacctcaaacgactctctaaaaatcttgccagatgtaaactctcatgtcattggccacctaaagccaaacacagagtattggatctttatctctgtcttcaatggagtccacagcatcaacagtgcaggacttcatgcaaccacttgcgatggggagcctcagggcatgcttcctccagaggttgtcatcatcaacagtacagctgtacgtgtcatctggacatctccttcaaacccaaatggtgttgtcactgagtattctatctatgtaaataataagctctacaagactggaatgaatgtgcctgggtcgtttattctgagagacctgtctcccttcactatctatgacattcaggttgaagtctgcacaatatatgcctgcgtgaaaagcaatggaacccaaattaccactgtggaagacactccaagtgatataccaacacccacaattcgtggcatcacttcaagatctcttcaaattgattgggtgtctccacggaagccaaatggcatcattcttggatatgatctcctatggaaaacatggtatccatgcgctaaaactcaaaagttagtgcaggatcagagtgatgagctctgcaaggcagtgaggtgtcaaaaacctgaatctatctgtggacacatttgctattcttctgaagctaaggtttgttgtaacggagtgctctataaccccaagcctggacatcgctgttgtgaagaaaagtatatcccgtttgttctgaattctactggagtttgttgtggtggccgaatacaggaggcacaaccaaatcatcagtgctgctctgggtattacgctagaattctaccaggtgaggtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccaggtatgttctgttgtgggcaggattatgtgaatatgtcagataccatatgctgctcagcttccagtggagagtctaaagcacatattaaaaagaatgacccggtgccagtaaaatgctgtgagactgaacttattccaaagagccagaaatgctgtaatggagttggatataatcctttgaaatatgtttgctctgacaagatttcaactggaatgatgatgaaggaaaccaaagagtgcaggatcctctgcccagcatctatggaagccacagaacattgtggcaggtgtgacttcaactttaccagccacatttgcactgtgataagagggtctcacaattccacagggaaggcatcaattgaagaaatgtgttcatctgccgaagaaaccattcatacagggagtgtaaacacgtactcttacacagatgtgaacctcaagccctacatgacatatgagtacaggatttctgcctggaacagctatgggcgaggactcagcaaagctgtgagagccagaacaaaagaagatgtgcctcaaggagtgagtccccctacgtggaccaaaatagacaatcttgaagatacaattgtcttaaactggagaaaacctatacaatcaaatggtcctattatttactacatccttcttcgaaatggaattgaacgttttcggggaacatcactgagcttctctgataaagagggaattcaaccatttcaggaatattcatatcagctgaaagcttgcacggttgctggctgtgccaccagtagcaaggtagttgcagctactacccaaggagttccggagagcatcctgccaccaagcatcacagccctaagtgcagtggctctgcatctgagctggagtgtccctgagaaatcaaacggcgtcattaaagagtaccagatcaggcaggttgggaaaggtctcatccacactgacaccactgacaggagacagcatacggtcacaggtctccagccatacaccaactacagcttcactcttacagcttgtacatctgctgggtgcacttcaagcgagccttttctaggtcagacactgcaggcagctcctgaaggagtttgggtgacacctcgacacattatcatcaattctacaacagtggaattatattggagtctgccagaaaagcccaatggcctcgtttctcaatatcaattgagtcgtaatggaaacttgcttttcctgggtggcagtgaggagcagaatttcactgataaaaacctggagcccaatagcagatacacttacaagttagaagtcaaaactggaggtggcagcagtgctagtgatgattacattgttcaaacacctatgtcaacaccagaagaaatctatcctccatataatatcacagtaattgggccttattctatatttgtagcttggataccaccagggatcctcatccccgaaattcctgtggagtacaatgtcttactcaatgatggaagtgtaacacctctggccttctccgttggtcatcatcaatccacccttctggaaaatttgactccattcacacagtatgagataaggatacaagcatgtcaaaatggaagttgtggagttagcagtaggatgtttgtcaaaacacctgaagcagccccaatggatcttaattctcctgttcttaaggcactggggtcagcttgcatagagattaagtggatgccacctgaaaaaccaaatggaatcatcatcaactactttatttacagacgccctgctggcattgaagaggagtctgttttatttgtctggtcagaaggagcccttgaatttatggatgaaggagacaccctgaggcctttcacactctacgaatatcgggtcagagcctgtaactccaagggttcagtggagagtctgtggtcattaacacaaactctggaagctccacctcaagattttccagctccttgggctcaagccacgagtgctcattcagttctgttgaattggacaaagccagaatctcccaatggcattatctcccattaccgtgtggtctaccaggagagacccgacgatcctacatttaacagccctaccgtgcatgctttcacagtgaagggaacaagccatcaagcccacctgtacgggttagaaccattcacaacatatcgcattggtgttgtggctgcaaaccatgcaggagaaattttaagcccttggactctgattcaaaccttagaatcttccccaagtggactgagaaactttatagtagaacagaaagagaatggccgggcattgctactacagtggtcagaacctatgagaaccaatggtgtgattaagacatacaacatcttcagtgacgggttcctggagtactctggtttgaatcgtcagtttctcttccgccgcctggatcctttcactctctacacactgaccctggaggcctgcaccagagcaggttgtgcacactcggcgcctcagcctctgtggacagatgaagcccctccagactctcagctggctcctactgtccactctgtgaagtccaccagtgttgagctgagctggtctgagcctgttaacccaaatggaaaaataattcgctatgaagtgattcgcagatgcttcgagggaaaagcttggggaaatcagacaatccaggccgacgagaaaattgttttcacagaatataacactgaaaggaatacatttatgtataatgacacaggtttgcaaccatggacgcagtgtgaatataaaatctacacttggaattcagctgggcatacctgtagctcttggaatgtggtgaggacattgcaagcacctccagaaggtctctctccacctgtgatatcctatgtttctatgaatccccaaaaactgctgatttcctggatcccaccagaacagtctaatggtattatccagtcctataggcttcaaaggaatgaaatgctctatccttttagctttgatcctgtgactttcaattacactgatgaagagcttcttcctttttccacctatagctatgcactccaagcctgcacgagtggaggatgctccaccagcaaacccaccagcatcacaactctggaggctgctccatcagaagtcagccctccagatctttgggccgtcagtgccactcaaatgaatgtatgttggtcaccgcccacagtgcaaaatggaaagattactaaatatttagttagatatgataataaagagtcccttgctggccagggcctgtgcctgctggtttcccacctgcagccttactctcagtataacttctcccttgtagcctgcacgaatggaggttgcacagctagtgtgtcaaaatctgcctggacaatggaggccctgccagagaacatggactctccaacattgcaagtcacaggctcagaatcaatagaaatcacctggaaacctccaagaaacccaaatggccagatcagaagttatgaacttaggagggatggaaccattgtatatacaggcttggaaacacgctatcgtgattttactctcaccccaggtgtggagtatagctacacagtaactgccagcaacagccaagggggtattttgagtcctcttgtcaaagatcgaaccagcccctcagcaccctcagggatggaacctccaaaattgcaggccaggggtcctcaggagatcttagtgaactgggaccctccagtgagaacaaatggtgatatcatcaattataccctcttcatccgtgaactatttgaaagagaaactaaaatcatacacataaacacaactcataattcttttggtatgcagtcatatatagtaaaccagctgaagccatttcacaggtatgaaatacgaattcaagcgtgcaccaccctgggatgtgcatcaagtgactggacattcatacagacccctgagattgcacctttgatgcaaccccctccacatctggaggtacaaatggctccaggaggattccagccaactgtttctcttttgtggacaggaccgctgcagccaaatggaaaagttttgtattacgaattatacagaagacaaatagcaactcagcctagaaaatccaatccagtcctaatctataacggaagctcaacatcttttatagattccgaactattgcctttcacagagtatgagtatcaggtctgggcagtgaattctgcaggaaaagcccccagtagctggacatggtgcagaaccgggccagccccaccagaaggtctcagagcccccacgttccatgtgatctcttctacccaagcagtggtcaacatcagtgcccctgggaagcccaacgggatcgtcagtctctacaggctgttctccagcagcgcccatggggctgagacagtgctatccgaaggcatggccacccagcagactctccatggccttcaagccttcactaactactctattggagtagaggcctgcacctgcttcaactgttgcagcaaaggaccgacagctgaactgagaacccatcctgccccaccctcaggactgtcctctccacaaatcgggacgctggcctcaaggacggcctccttccggtggagtccccccatgttccccaatggtgtcattcacagctatgaactccaattccacgtggcttgccctcctgactcagccctcccctgtactcccagccaaatagaaacaaagtacacggggctggggcagaaagccagccttgggggtctccagccctacaccacatacaagctgagagtggtggcacacaacgaggtgggcagtacggcttccgagtggatcagtttcaccacccaaaaagaattgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaaccttctttttccaggtcatctgcacgactgacgaaggaagtgttaagacgccgttgatccaatatgatacctctactggacttggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatgtttgactctgtggctgatatatctgatgtgtcaagcaatgtcaccctaaaaagttacaccatgcactttgaggggttagccgataccaaaattccccggtctgggacacctgtgagtatccgcagcaaccggagtgcatgtgtcctgcgcatcccgagtcaaaaccaaaccagcctaacctactcccagggttctcttcaccgcagcgtcagccagctcatggacattcaagacaagaaagtcttgatggacaactcactgtgggaagccatcatgggccacaacagtggactgtatgtggatgaagaggacctgatgaacgccatcaaggatttcagctcagtgactaaggaacgcaccacattcacagacacccacctgtaaaggatggaaacccagaagacgtaaccctggaatgcaaggtctgcacccatttcctcctgggttatcactcacacatcataaatgctgaaaagccattgtttattatcctataattctttaaagaaatgatgactgtttttgaaagtgttccttcctaatagaggtctaagaaatgatatttttctcatcttaaatgagagagaatattcatatgaaaatacttgatttgctcttattttgtagaagacaaagaagtatgtaattgtcacttggttctgtttggcagtgatgctcctggttaactgaataatcagtggcaatttcaagatggctcacagttgttagaagtagtaagttagttactggctcaaaaatgattctgttgaaaggatgtcactgctgttcatttctatctgccatttctgtcagggttgacacaatcctgcaagaatagttattctaatgatcacagctgctaaatgaatcccaaactttgcaccaggtcgacaaacttttctgaaggttctatttatttaccatacatagggttacttaccaaactttttgacaaggctgaaggttctatttatttacaatacatagggttactcaccaaactttttgacaaggcaacacataacttacacataaatgtctctgttcttgcatttatgaattttccaaaaatctaaggagtaaacagcttatttatacattttgaggagaaaacaaagtgtttcactaggaacacctctacttgaaccaatgtttttatttcatatattttatagttttgaaactagtttctcataaaattctgtcaattcactgaatatcagagaatactgacatcttcaacctagcacatttcaaatggaaactactgttctatttgcaatattaggctgcgtgaaattttaaaaggaaaaatgtatctgttccttctagcattaacatatatacatgtagagacaagactatacctatgtgtatatatatgtatatcatgtatatattactctgcactatatcccttctttttggagaactagccattattttagccacagaatcagtaagaacagatgatatgcaacagtaccaattacggttcaaaaatgtctgtcacctgctctagttggattacaaagtcattggtgaaagtcctatggcaagaaaaattttcttgcaaatcatccacataaaatcagatatttaaatttgttcttcatggaaaacagagtaagaaaacctcttgtcttccttcatccttaaaggtctttgtgaccccaggaaaatattgactctgtctaacacacaatagtcacaatactttttgtgaatctacaaccagagacaggcaaaaacttgtaaagtaagggatagtcttacttattctgcctgaaaacaatgtattaccccagggcccaacagtaaaagattgtggactttttgggtattgagatttcatctagctctgtgagagagcagctcctcagactgaccaactcctagacaaagtttgccaaccataagtgtcaaaagcacaggccagtattaagcagaagttctaccaccttattagaactgctataaacaaaagcatctgaaataattgtgcacatctggcagtgactgtagaaaatacgaaatatatatttctcgccaagtttttatactttctgaaatgaaaacataggattgactagtttactggtttttattcccatatgccgattctgggacaataaagttgtttaaagctggcacaaataagcattaaccaaggctgtgtccaccttctgtgagctacttaaggtatataggaaaggagtggtcacaaacttgcatcctaatccttggtggactcttctaagaatacagtttgctagtcacaaagaatagtctacaaatatgctttgctaggttcagaagattgagtttatcctgatttttgaaaaattaaccaggtatctttatcactgtgtatttttccaagcacagtataaaattttaacaacgcacaaaaaaatacagaactgcaggggattttatcttggatcattatccatttaatcatctaattagacatgaactcagttagctgaatcatttacattttgactccatagcttagggcagacagaagcctgtatggcttctgcccagaactctgtcccctgctacatgtctaagtttacttgtatttatttcagagaagaactctaagatgttgctttgctactttaagtggtattgcgtgccaagcctctattatacaaaccatgcagactcgcctctagagattctgattcggttgatctggggtgtgtggctgaggcatcagtactttttaaagcttccaggtgttctaatgttgagacccactgatgttccacaatctggaagaaatcatgtacaggaataatatgctatgcacagggactatgctccttggctcaccccttctcccttataaacaatgagcagttcttgatgaacctctttaaatttaaatctcctgactcacattttaccaattgtacatgccacattctcagcttacgaactaccatgttttgttattcttaatatcaactgtttggtaagagtacagttgtttttatacactctaagaaatgtgtttataatctactgtaatttccactaaatggaacccaaatattaatgttatggtaccatatactgatgtaaaaatcatgctggcatccatgaacacaccggtaaataaaacatagtccaagtggaagaattcattaataaggaacttttaattatgtcacaaatgaatagttggtttccaatgcacaaatatcatgtaaactaatctaaagatggtttgcttaataaatatttgaatgtgacc

SEQ ID NO: 33974 - DNA, 4512 bp, Homo sapiens
actataaaataataatgaaatcttggaatagataagttactctatgaggactgaagctgttgttaattcccaaggccagactgattatctcacaaaggattcagaccaggatgtagcactcaaacttgcccaggagcgagctgaaatagttgctaaatatgacagaggacgagaaggtgcagagattgaaccttgggaagatgctgattaccttgtttacaaagtcacagatagatttggctttttacatgaggaggagctcccagatcataatgtggctgtggaacggcaaaagcacctggaaattgaaagaactaccaaatggctgaaaatgctgaaaggatgggaaaaatacaagaacactgaaaagtttcataggcgaatttacaaaggaataccactccagctcagaggtgaagtctgggccctccttcttgagatccctaaaatgaaagaagaaacaagggacctgtatagtaaattaaaacacagagcacggggctgttcacctgacatcagacaaatagacctggatgtcaaccgcacatttcgggaccacattatgtttagagacagatatggtgttaagcaacaatccttattccatgtgcttgctgcctattctatttataacacggaagtcgggtattgtcaggggatgagccagatcacagctttactcctcatgtatatgaacgaggaagatgccttctgggccctggtcaaactcttctcaggccctaaacatgccatgcatggcttttttgtccaaggttttcctaaactcttgaggtttcaagaacatcatgaaaaaatactgaacaaatttctgtccaagcttaagcaacacttggattctcaagaaatctacacaagtttttacacaatgaaatggttttttcagtgtttccttgatcgtactccctttacactaaacctcagaatatgggatatctacatctttgaaggagaacgagttcttactgctatgtcttacaccatcttaaaattacacaaaaaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaaagaggatgaatatccaaagaagcccttggggcagcttccacctgaacttcagtcttggggcgtccatcacttgagcaacggacagaggagcgtgggccggccgagcccgctggccagcggcaggagggagagcggggcgccccacaggaggcacgagcactccccgcacccccagagcaggaccgggacgcccgagagagcacagccgccaagacggaaatcggtggaggaggagagcaaaaagcttaaagatgaggcagattttcaaagaaaactcccatcgggtccacaggacagttccaggcaatataatcacgcagctgccaaccaaaatagcaacgccacttcaaatatcaggaaggagtttgtgcccaaatggaataaaccgtcagacgtctcagctacagagagaactgccaaatacaccatggaaggcaaaggtcgagcagcgcaccccgcgctcgcagttaccgtcccaggtcctgccgaggtgcgggtgtcaaacgtgcggccaaagatgaaggccctggatgctgaggacgggaagcggggctccactgcatcgcagtacgacaacgtgccaggcccggagctggacagcggcgcttccgtggaggaggcgctggaaagggcttactcccagagcccccggcatgccctttaccctcctagcccgagaaagcacgctgagccaagttctagtccatcaaaagtatccaacaagtttacttttaaagtacagcctccaagtcatgcacgatatccgtcccagctagatggggaagcccgagggctagctcatcccccctcctacagcaatccccccgtttaccacggaaactctcccaaacacttccctactgccaacagcagctttgcttctccacagtttagccctgggactcaactgaatccttccaggagacctcatggttctactctttccgtcagtgcttctccggagaaatcttacagccgcccaagcccccttgtactgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttaccaaaatactcagcctttcaactcgcaccctttcaggaccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtagtaagaatacagggaaatgtcttcagccccacgtagatgctgcttaagatgagcgtttcaattgcatcatcactgacctgttagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcagtgtggttacttctttcttctgcctcgactcacatggcttctccccacgaaggtcccagggtggccatttatacaatccatttctgtcctctttatggaatgtagtcgacggatattgctgcacctcatcaggccattacattgtccatgttaaaattataaaaatgatcctagtttttcataggagtctaggattttgatcttttaaaaaatacagtgtgatttcatgcttttgaacatctttttttcattgaaacaaattcaagttcttggcttaaaaaaaaattagtgatgtctttaaaaaatattctgttacactacagataccaaaacactgacaaagatttaggcactccaagagagtatgacttcgtgtttaattggggagcttgttttcaacattgcttatatttgaatagtagaaaacccgacattgatgtttcttcctgttgcaaggtggggctttaaactttcaaggtacaaaagtatgtcttttaaaatggaagtaacgtttgtttagctagtgaatgtgacaatatattttatgtatataatgagtctaatgtaattttgatcaacttggtaatgatgttattaaatagcaaaacaagtgcagtgtattaaagctaaacactacattgaaacgcaaacaaaattctggtgaaataactgggctgttgatgcaggtcaggtggaagctgagaaataaatgtatataaatatgtagctgaggatattaattcccattatataaccataattctgtgacttgtaataaaccaagctgtacaatttagtttataatagcagtatctgagctgctccaaaatatatatatcaacagtggtaaatactgtagatttttatatatatatatatatatatatatatatatgcaaaaaatatatatatacacacaagcactattttcttatgtcatttatgacattttttatctgtatacttttttgatgtgattgttttttaacatgctaaaagtaataagtata

SEQ ID NO: 33975 - DNA, 4811 bp, Homo sapiens
cggccgctgcggtgacggttggcggcggccggtgaggcgggcggggccggaggcgcggaggcggggtcccgggcgagccgccctgggaggcgggggccgtttccatagcggcggcaggaggtgtcgcgccggggaacttcctggttcccgggctcggcttcgccgggatcctcttggaagggaaacaatggggcggagggcactgcggtagccgccgccgccgccgcgccgcgccgcgccggatctgctcggccgcccgggaccgccagctctgtccgctgcccacagcctagcagtcgggaccgtactgaggacatgtattcctctgagaaaccttggacagcagattttggtttaatatctgattgggacaacattcagacccatttccagtcatgaattcagaccaggatgtagcactcaaacttgcccaggagcgagctgaaatagttgctaaatatgacagaggacgagaaggtgcagagattgaaccttgggaagatgctgattaccttgtttacaaagtcacagatagatttggctttttacatgaggaggagctcccagatcataatgtggctgtggaacggcaaaagcacctggaaattgaaagaactaccaaatggctgaaaatgctgaaaggatgggaaaaatacaagaacactgaaaagtttcataggcgaatttacaaaggaataccactccagctcagaggtgaagtctgggccctccttcttgagatccctaaaatgaaagaagaaacaagggacctgtatagtaaattaaaacacagagcacggggctgttcacctgacatcagacaaatagacctggatgtcaaccgcacatttcgggaccacattatgtttagagacagatatggtgttaagcaacaatccttattccatgtgcttgctgcctattctatttataacacggaagtcgggtattgtcaggggatgagccagatcacagctttactcctcatgtatatgaacgaggaagatgccttctgggccctggtcaaactcttctcaggccctaaacatgccatgcatggcttttttgtccaaggttttcctaaactcttgaggtttcaagaacatcatgaaaaaatactgaacaaatttctgtccaagcttaagcaacacttggattctcaagaaatctacacaagtttttacacaatgaaatggttttttcagtgtttccttgatcgtactccctttacactaaacctcagaatatgggatatctacatctttgaaggagaacgagttcttactgctatgtcttacaccatcttaaaattacacaaaaaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaaagaggatgaatatccaaagaagcccttggggcagcttccacctgaacttcagtcttggggcgtccatcacttgagcaacggacagaggagcgtgggccggccgagcccgctggccagcggcaggagggagagcggggcgccccacaggaggcacgagcactccccgcacccccagagcaggaccgggacgcccgagagagcacagccgccaagacggaaatcggtggaggaggagagcaaaaagcttaaagatgaggcagattttcaaagaaaactcccatcgggtccacaggacagttccaggcaatataatcacgcagctgccaaccaaaatagcaacgccacttcaaatatcaggaaggagtttgtgcccaaatggaataaaccgtcagacgtctcagctacagagagaactgccaaatacaccatggaaggcaaaggtcgagcagcgcaccccgcgctcgcagttaccgtcccaggtcctgccgaggtgcgggtgtcaaacgtgcggccaaagatgaaggccctggatgctgaggacgggaagcggggctccactgcatcgcagtacgacaacgtgccaggcccggagctggacagcggcgcttccgtggaggaggcgctggaaagggcttactcccagagcccccggcatgccctttaccctcctagcccgagaaagcacgctgagccaagttctagtccatcaaaagtatccaacaagtttacttttaaagtacagcctccaagtcatgcacgatatccgtcccagctagatggggaagcccgagggctagctcatcccccctcctacagcaatccccccgtttaccacggaaactctcccaaacacttccctactgccaacagcagctttgcttctccacagtttagccctgggactcaactgaatccttccaggagacctcatggttctactctttccgtcagtgcttctccggagaaatcttacagccgcccaagcccccttgtactgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttaccaaaatactcagcctttcaactcgcaccctttcaggaccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtagtaagaatacagggaaatgtcttcagccccacgtagatgctgcttaagatgagcgtttcaattgcatcatcactgacctgttagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcagtgtggttacttctttcttctgcctcgactcacatggcttctccccacgaaggtcccagggtggccatttatacaatccatttctgtcctctttatggaatgtagtcgacggatattgctgcacctcatcaggccattacattgtccatgttaaaattataaaaatgatcctagtttttcataggagtctaggattttgatcttttaaaaaatacagtgtgatttcatgcttttgaacatctttttttcattgaaacaaattcaagttcttggcttaaaaaaaaattagtgatgtctttaaaaaatattctgttacactacagataccaaaacactgacaaagatttaggcactccaagagagtatgacttcgtgtttaattggggagcttgttttcaacattgcttatatttgaatagtagaaaacccgacattgatgtttcttcctgttgcaaggtggggctttaaactttcaaggtacaaaagtatgtcttttaaaatggaagtaacgtttgtttagctagtgaatgtgacaatatattttatgtatataatgagtctaatgtaattttgatcaacttggtaatgatgttattaaatagcaaaacaagtgcagtgtattaaagctaaacactacattgaaacgcaaacaaaattctggtgaaataactgggctgttgatgcaggtcaggtggaagctgagaaataaatgtatataaatatgtagctgaggatattaattcccattatataaccataattctgtgacttgtaataaaccaagctgtacaatttagtttataatagcagtatctgagctgctccaaaatatatatatcaacagtggtaaatactgtagatttttatatatatatatatatatatatatatatatgcaaaaaatatatatatacacacaagcactattttcttatgtcatttatgacattttttatctgtatacttttttgatgtgattgttttttaacatgctaaaagtaataagta

SEQ ID NO: 33976 - DNA, 4739 bp, Homo sapiens
gagccgccctgggaggcgggggccgtttccatagcggcggcaggaggtgtcgcgccggggaacttcctggttcccgggctcggcttcgccgggatcctcttggaagggaaacaatggggcggagggcactgcggtagccgccgccgccgccgcgccgcgccgcgccggatctgctcggccgcccgggaccgccagctctgtccgctgcccacagcctagcagtcgggaccgtactgaggacatgtattcctctgagaaaccttggacagcagattttggtttaatatctgattgggacaacattcagacccatttccagtcatgaattcagaccaggatgtagcactcaaacttgcccaggagcgagctgaaatagttgctaaatatgacagaggacgagaaggtgcagagattgaaccttgggaagatgctgattaccttgtttacaaagtcacagatagatttggctttttacatgaggaggagctcccagatcataatgtggctgtggaacggcaaaagcacctggaaattgaaagaactaccaaatggctgaaaatgctgaaaggatgggaaaaatacaagaacactgaaaagtttcataggcgaatttacaaaggaataccactccagctcagaggtgaagtctgggccctccttcttgagatccctaaaatgaaagaagaaacaagggacctgtatagtaaattaaaacacagagcacggggctgttcacctgacatcagacaaatagacctggatgtcaaccgcacatttcgggaccacattatgtttagagacagatatggtgttaagcaacaatccttattccatgtgcttgctgcctattctatttataacacggaagtcgggtattgtcaggggatgagccagatcacagctttactcctcatgtatatgaacgaggaagatgccttctgggccctggtcaaactcttctcaggccctaaacatgccatgcatggcttttttgtccaaggttttcctaaactcttgaggtttcaagaacatcatgaaaaaatactgaacaaatttctgtccaagcttaagcaacacttggattctcaagaaatctacacaagtttttacacaatgaaatggttttttcagtgtttccttgatcgtactccctttacactaaacctcagaatatgggatatctacatctttgaaggagaacgagttcttactgctatgtcttacaccatcttaaaattacacaaaaaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaaagaggatgaatatccaaagaagcccttggggcagcttccacctgaacttcagtcttggggcgtccatcacttgagcaacggacagaggagcgtgggccggccgagcccgctggccagcggcaggagggagagcggggcgccccacaggaggcacgagcactccccgcacccccagagcaggaccgggacgcccgagagagcacagccgccaagacggaaatcggtggaggaggagagcaaaaagcttaaagatgaggcagattttcaaagaaaactcccatcgggtccacaggacagttccaggcaatataatcacgcagctgccaaccaaaatagcaacgccacttcaaatatcaggaaggagtttgtgcccaaatggaataaaccgtcagacgtctcagctacagagagaactgccaaatacaccatggaaggcaaaggtcgagcagcgcaccccgcgctcgcagttaccgtcccaggtcctgccgaggtgcgggtgtcaaacgtgcggccaaagatgaaggccctggatgctgaggacgggaagcggggctccactgcatcgcagtacgacaacgtgccaggcccggagctggacagcggcgcttccgtggaggaggcgctggaaagggcttactcccagagcccccggcatgccctttaccctcctagcccgagaaagcacgctgagccaagttctagtccatcaaaagtatccaacaagtttacttttaaagtacagcctccaagtcatgcacgatatccgtcccagctagatggggaagcccgagggctagctcatcccccctcctacagcaatccccccgtttaccacggaaactctcccaaacacttccctactgccaacagcagctttgcttctccacagtttagccctgggactcaactgaatccttccaggagacctcatggttctactctttccgtcagtgcttctccggagaaatcttacagccgcccaagcccccttgtactgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttaccaaaatactcagcctttcaactcgcaccctttcaggaccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtagtaagaatacagggaaatgtcttcagccccacgtagatgctgcttaagatgagcgtttcaattgcatcatcactgacctgttagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcagtgtggttacttctttcttctgcctcgactcacatggcttctccccacgaaggtcccagggtggccatttatacaatccatttctgtcctctttatggaatgtagtcgacggatattgctgcacctcatcaggccattacattgtccatgttaaaattataaaaatgatcctagtttttcataggagtctaggattttgatcttttaaaaaatacagtgtgatttcatgcttttgaacatctttttttcattgaaacaaattcaagttcttggcttaaaaaaaaattagtgatgtctttaaaaaatattctgttacactacagataccaaaacactgacaaagatttaggcactccaagagagtatgacttcgtgtttaattggggagcttgttttcaacattgcttatatttgaatagtagaaaacccgacattgatgtttcttcctgttgcaaggtggggctttaaactttcaaggtacaaaagtatgtcttttaaaatggaagtaacgtttgtttagctagtgaatgtgacaatatattttatgtatataatgagtctaatgtaattttgatcaacttggtaatgatgttattaaatagcaaaacaagtgcagtgtattaaagctaaacactacattgaaacgcaaacaaaattctggtgaaataactgggctgttgatgcaggtcaggtggaagctgagaaataaatgtatataaatatgtagctgaggatattaattcccattatataaccataattctgtgacttgtaataaaccaagctgtacaatttagtttataatagcagtatctgagctgctccaaaatatatatatcaacagtggtaaatactgtagatttttatatatatatatatatatatatatatatatgcaaaaaatatatatatacacacaagcactattttcttatgtcatttatgacattttttatctgtatacttttttgatgtgattgttttttaacatgctaaaagtaataagtata

SEQ ID NO: 33977 - DNA, 2019 bp, Homo sapiens
tggcggcagaggcagtgcggatccggcgttctccactgatcttttccaaggctgtacagacatggcggcggcttttcggaaggcggctaagtcccggcagcgggaacacagagagcgaagccagcctggctttcgaaaacatctgggcctgctggagaaaaagaaagattacaaacttcgtgcagatgactaccgtaaaaaacaagaatacctcaaagctcttcggaagaaggctcttgaaaaaaatccagatgaattctactacaaaatgactcgggttaaactccaggatggagtacatattattaaggagactaaggaagaagtaaccccagaacaactaaagctgatgagaactcaggacgtcaaatatatagaaatgaagagggttgcagaagctaagaaaatcgaaagactaaaatcagagctccatctgctggatttccaggggaagcaacagaacaagcatgtgttcttttttgacaccaaaaaggaagttgaacagtttgatgtcgcaactcacctgcaaacagccccggagctagtcgacagagtctttaataggcccaggatagagaccttgcagaaagaaaaagtgaaaggagttaccaatcagactggacttaagcgaatagctaaagaaaggcaaaagcagtataactgcctgacacagcggattgaacgagagaagaaattgttcgttattgctcagaaaattcaaacacgcaaagatcttatggataaaactcagaaagtgaaggtgaagaaagaaacggtgaactccccagctatttataaatttcagagtcgtcgaaaacgttgacgtgttatagataagccttgtcattctgtatcaaaaatctgttgtcgttttctagtaacttcaaattccattactccaaatggcatggttttccggtttgtaaccataactaaattgtcagtctgacatttaatgtctttctatggacaacattaaatctccctcccttctgtaattgtttttggattgtgaaattagtcttatttttatatacttaattttttttttctttgagatagggtctttgttgccaggctggaagtgcagtgtgtgattatggctcactgcaactttgaactcctgggctcaagtgatcttcctgcatcagcctcttgagtagctgggaccacagacatgtgccaccatgtctgagtaatgtttaaattttctgtagagaccaggttttgccatgttggccaggctggttttgaactcgtggcctcaagcgatcctcccaccttggcctcccaaagggctgggattacagggatgagccactatgcccagcccataattttttttgttatgaaacataggatctcattacagcagatttggaaagtagattaattcattcctaatcccagtgcttattcaataataacaaatatttattgcatgcttaactgtgctaggagctagagctgtggaggtggacaattactgtgagtagtctagttgatttcctccattttgtaaaacgaggcatcactttttgtccatgtttttgtgttttatagttacagtaaacaatttgatgtcctactttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcctggctaatttttttttgtatttttttagtagagacggggtttcaccttgttagccaggatggtctcgatctcctgacctcatgatccacccgcctcggcctcccaaagtgctgggattacaggcgtgagccaccgcgcccggccgatgtcctactttttaattaaatcattagctctttcccagtttgttacatcacaaaagttttttacagtaatatatgctagagtaaacgttaaaataaatattatttttaatgattgc

SEQ ID NO: 33978 - DNA, 875 bp, Homo sapiens
gatcttttccaaggctgtacagacatggcggcggcttttcggaaggcggctaagtcccggcagcgggaacacagagagcgaagccagcctggctttcgaaaacatctgggcctgctggagaaaaagaaagattacaaacttcgtgcagatgactaccgtaaaaaacaagaatacctcaaagctcttcggaagaaggctcttgaaaaaaatccagatgaattctactacaaaatgactcgggttaaactccaggatggagtacatattattaaggagactaaggaagaagtaaccccagaacaactaaagctgatgagaactcaggacgtcaaatatatagaaatgaagagggttgcagaagctaagaaaatcgaaagactaaaatcagagctccatctgctggatttccaggggaagcaacagaacaagcatgtgttcttttttgacaccaaaaaggaagcgaatagctaaagaaaggcaaaagcagtataactgcctgacacagcggattgaacgagagaagaaattgttcgttattgctcagaaaattcaaacacgcaaagatcttatggataaaactcagaaagtgaaggtgaagaaagaaacggtgaactccccagctatttataaatttcagagtcgtcgaaaacgttgacgtgttatagataagccttgtcattctgtatcaaaaatctgttgtcgttttctagtaacttcaaattccattactccaaatggcatggttttccggtttgtaaccataactaaattgtcagtctgacatttaatgtctttctatggacaacattaaatctccctcccttctgtaattgtttttggattgtgaaattagtcttatttttatatacttaatt

SEQ ID NO: 33979 - DNA, 1894 bp, Homo sapiens
gggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaa

SEQ ID NO: 33980 - DNA, 1666 bp, Homo sapiens
gcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaaggcaaggccctga

SEQ ID NO: 33981 - DNA, 9025 bp, Homo sapiens
aggctcctccttgtctccaacatggcggcgcccaggggctcaagccgcacgtgagaaagtctgggcatctgggaatcggagagtatagcctgtgagccgctttcccctccttactgtcggttgcatcccttcgacactcccgaggccgtcgcgggccactggccctctgcagccatgaagacaaagcccgtttcccacaagaccgagaacacctaccggtttcttacatttgctgaacgactggggaatgttaatattgatattattcaccggattgatagaactgcaagctatgaggaggaggttgaaacctacttttttgagggtctgctgaaatggagagaattaaacctcacagaacacttcggaaaattttacaaagaagttattgacaaatgccaatcattcaatcagttggtgtatcaccaaaacgagatagttcagagtttgaagactcacctgcaagttaagaacagttttgcctatcaaccccttttggatttggttgtacagttggcacgagatctgcagatggatttctacccacactttccagagttttttttgactatcacctcgatcctggagactcaggacacagagttgttagaatgggctttcacctcgttatcatatctttataagtacctgtggagactgatggtgaaggacatgtccagtatatacagcatgtacagcacactcctggctcataaaaaactacatataagaaattttgctgctgaaagttttacttttttgatgagaaaggtctctgataaaaacgcacttttcaatttaatgtttcttgatcttgataaacatccagaaaaagttgaaggtgttggacagttgctctttgaaatgtgcaaaggagttagaaatatgtttcactcctgtacaggccaggcagtgaagctaattttgcgaaagctaggaccagtcactgaaacagaaactcaactaccatggatgttaattggagaaacactcaaaaacatggtcaaatccactgtatcctacatctccaaggaacattttggtacattttttgaatgtttgcaagaatcgctcttggatctacacacaaaagtaacaaaaactaactgttgtgaaagttctgaacagattaaaaggttgttggaaacataccttatacttgtaaaacatggaagtgggacaaagatacccacgcctgctgatgtctgtaaggtgttatctcaaacactgcaagtagccagtctctccacatcttgctgggagaccctcttggatgtaatttctgctttgatcctgggtgaaaatgtttccttgccggagaccctcatcaaagaaaccatagaaaaaatatttgagagcagatttgaaaaacgtttaattttcagtttttctgaagtcatgtttgccatgaagcagtttgagcagctttttctaccaagctttctgtcatatattgtgaattgcttcttaattgatgatgctgtagtcaaagatgaagctctggccattctggccaagctcattctgaacaaagcagcacctcccactgctggctcgatggcaattgaaaagtaccctctggttttctcaccgcagatggtgggattctatataaagcagaagaagactagatccaagggaagaaacgaacagtttccagtattggaccatcttttatctataattaagttacccccaaataaagatactacttacctttcacaatcttgggcagccctcgtggtgttacctcatattagacctcttgagaaagagaaggtgataccactcgtcaccggcttcatagaggcactcttcatgactgttgacaaaggaagctttgggaaaggaaacttatttgttctttgtcaagctgtaaatactctactaagtttggaagaatcttctgaacttcttcatttggttcctgtggaacgtgtgaagaatttagtattaacctttcccctggagccatctgtgttgctgttgactgatctctattatcagagattagccttgtgtggctgcaaagggccactttcccaggaggctttaatggaattatttcccaagttacaagcaaacatttcaactggtgtatccaagattcggcttttgacaataaggatcctaaaccattttgatgtccagcttccagaatcaatggaggatgatgggctctcagagcggcagtctgtctttgctatattacgccaggcagaacttgttccagcaactgtgaatgattatagagagaagcttcttcatttgagaaaactaagacatgatgtggtacagactgctgtccctgatgggccgttacaggaggtgccgcttcgttatttgttaggcatgctatatattaatttcagtgcactctgggatcctgttattgaactcataagttctcatgcacacgaaatggaaaataagcaattttggaaagtctactatgagcatctagaaaaagcagctacgcatgctgagaaggaactacagaatgatatgacagatgagaagtccgttggagatgaaagttgggagcagacccaggaaggagatgttggagctctttatcatgagcagttagcattgaaaactgactgtcaggaaagacttgaccacaccaacttcagattcctgctctggagagctctgaccaaattcccagaaagagtagagccacggtccagggagctttccccgcttttcttgagatttatcaacaatgagtattacccagcagatctgcaagttgctccaacccaggatctacggagaaaaggcaaagggatggtggcagaggaaatcgaagaggaacctgccgcaggagatgatgaagagttggaggaagaggcagtgccccaagatgaatcctcacagaagaaaaagacgaggagagctgcagcaaagcaattaattgctcatttgcaagttttctctaaattttcaaatccacgggccttatatctggaatccaaactatatgagttatatcttcagttgttgctacaccaagatcaaatggtgcaaaaaataaccttggattgcataatgacatataaacatcctcatgtcctcccttacagggaaaacttacaaaggttgcttgaagacagaagctttaaggaagagatagtgcattttagcatttcagaagataatgctgtagtgaaaacagcccaccgagcagatctatttcctattctgatgagaattttgtatgggcgaatgaagaataagactgggagtaaaactcaggggaaatctgcttcaggcacccgcatggccattgtcctgcggttcctggccgggacccaacctgaggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcagaaacgcaagatatttccctttgctggctaaacagaagcctgggcacccagaatgtgatatcctgaccaatgtttttgcaattctctcagcgaagaatctttctgatgccacagccagtattgtaatggacatagttgatgaccttcttaaccttccagatttcgagcctacagaaacagttttgaacttgctggtaactggatgtgtataccctggcatagcagaaaacatcggtgagtctatcacaataggaggaagattaattctacctcatgtacctgcaattcttcagtatctcagcaaaaccacaataagcgcagaaaaggtgaaaaagaaaaagaatagagcacaagtcagtaaagagcttggcattctttcaaagatcagcaagtttatgaaagacaaagaacaaagttctgtactcattacgcttctccttccattcctccaccgtggcaatattgctgaggatacagaggttgatattctggtgacagtacaaaacttgttaaagcattgtgtggaccctacaagcttcctcaagcctatagcaaaacttttctcagttattaagaacaaattgtcaagaaaattgctttgtacggtttttgagactctttctgattttgagagtgggttaaaatatattactgatgttgtcaagcttaacgccttcgatcaaagacatcttgatgatatcaacttcgacgttcgctttgagactttccagaccatcacctcttacattaaagaaatgcaaattgtggatgttaactacctaattccagttatgcataattgtttctataatctagagttaggagatatgagtttaagtgataatgccagcatgtgcctgatgagtatcatcaaaaagctagctgccttgaatgtcacagagaaagactatagagaaatcatccaccgttcactcctggagaaattgagaaaaggtctgaagagccagacagagagtattcagcaggattataccacaatactttcctgtttaattcaaacctttccaaaccaactggaattcaaagacttggtacaacttactcattaccatgacccagaaatggacttctttgagaacatgaagcacattcagatccacagaagagcaagagccttgaagaaacttgcaaaacaactaatggaaggcaaagttgttctgtcttctaaatctcttcagaattacatcatgccttatgccatgactccaatttttgatgagaaaatgctcaagcatgaaaatataaccactgctgccacagagattattggagccatttgcaaacatctctcttggtcagcgtatatgtattacttgaaacatttcattcatgtcttacaaacgggacagatcaatcaaaaactgggtgtcagtttgctagtaatagtgttagaagcattccactttgaccacaaaactcttgaagaacaaatgggaaaaattgagaatgaagaaaacgcaattgaagcaattgagttaccagagcctgaggccatggaattagagcgtgtggatgaggaagagaaggaatatacatgcaagagtttgtcagacaacggacaaccgggaacccctgatccagctgactctggaggaacatcagctaaagaatccgagtgtatcacaaagcctgtctctttccttcctcaaaacaaggaagaaatagagagaacaattaaaaatatccaaggaaccataaccggggatattctccccaggctacataaatgccttgcatctacgactaaaagggaagaagaacacaagcttgtcaagtcaaaggttgtgaatgatgaggaagtcgttcgagttccattagcttttgccatggttaaactaatgcagtcccttccacaagaagttatggaagctaatctgccaagtattttgctgaaagtgtgtgccctactcaagaacagagcccaagaaatcagagacattgcacgcagcactcttgcgaaaataatagaggatcttggtgtgcacttcctcctatatgttttaaaagaattacagactactcttgtccgtggataccaggtccatgtgctgactttcaccgttcacatgctgctgcaaggcctcaccaataagctgcaggtcggagatttggactcttgtttagatataatgattgagatttttaaccatgagttgtttggtgctgttgctgaagagaaggaagtaaagcagatcctctccaaagtcatggaagcacgaagaagcaaaagttacgactcttatgaaatcctcggcaagtttgtaggaaaagatcaggttacaaaactcatccttccattaaaagagatcttacaaaataccacgagtttgaaactggcccggaaagttcatgaaactttacgccgaatcacagtgggattaattgtaaatcaggaaatgacagctgaatccattctattactcagttatggtttgatcagtgaaaatcttcccctgttaacagagaaagaaaaaaatccagtagccccagcaccagatccacgtctaccaccccagagctgccttctgcttcccccaactccagttcgaggtggacagaaagctgttgtgagcaggaaaaccaacatgcacatatttattgagtccgggcttcggctgctgcatctgagtctgaagacttccaagatcaagtcttcaggtgaatgtgtcctggaaatgctggatccttttgtgtctctcctcatagactgcctgggctccatggatgtgaaggtgatcacaggtgctttacagtgcctcatctgggtcttgaggttcccgctaccttccatagaaacaaaagcagagcagctgacaaaacacctcttccttctgctgaaggactatgcaaagctcggggccgccaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgttctttatccctctttgtctaatgacgatcaatgatgactctgccacgtgcaaaaagatggcatccatgacaatcaagtccctacttggtaaaatcagcctcgagaaaaaagattggctgtttgatatggttaccacttggtttggagcaaaaaagcgcttaaatagacaacttgctgccctgatctgtggcttgtttgtggaaagtgaaggagttgattttgagaaaagacttggaactgtccttcctgtgattgaaaaggaaattgatcctgaaaactttaaagatatcatggaagaaactgaagaaaaagctgcagatcgccttctgtttagttttcttacactgataactaaacttatcaaggaatgtaatattattcagtttaccaaacccgctgagactttgagtaaaatctggagtcatgtgcattctcacctgagacatccacacaactgggtgtggctcacagcagcccagatttttggattactctttgcctcttgccagccagaggagcttattcaaaaatggaataccaaaaagaccaaaaaacacctcccagaacctgtagcaatcaagttcctagccagtgaccttgaccaaaagatgaaaagtatctctctcgcctcttgccatcaattgcattccaaattcttggatcagtctctaggagaacaggttgttaagaatttgttgttcgcagccaaagtcttgtatttactggaactttattgtgaggataagcaaagtaagataaaagaagacctggaagaacaagaagctttagaagatggtgtggcctgtgcagatgagaaggcggagtctgacggagaagagaaggaagaggtgaaggaagagctcggcaggccggccacgctgctgtggttgatccagaagctgtcccggattgcaaaactggaagctgcttattcgccgagaaaccccttaaagagaacatgcatctttaagttcctcggcgccgtagcaatggatcttgggatagacaaggtaaagccgtatctcccaatgatcatagctcctttgtttcgggaactcaacagcacctattcagagcaagatcctttgctgaagaatctatcccaggaaatcatagaattactcaaaaagctggttgggcttgagagcttctcattagcctttgcctctgtacagaaacaggctaatgagaaaagggcactccggaaaaagaggaaggccctggagtttgtaactaatcctgatattgctgccaagaaaaaaatgaagaaacacaaaaataaaagtgaagcaaagaagagaaagatagagttcctgcgtccaggatataaggccaagagacaaaaaagccatagcctgaaagatttagcaatggtggagtaatgtctccctgtgctgatacaagcatgaactttctggaatattctgctagtctgaaattacagtaggttgtctggggtaggggggaggcgtttttttttttttttgagacaaggtctcactctgtcacccaaggtggagtgcagtgacgacatcacagctcactgcagcctcaacctgggttcaagtgatcctctcacctcagcctcccaagtagttgtgcctcctaggcacacaacactatgcccggcaaattttttgtattttgtattttttgtagaaacaggatttcgccatgttggccaggctggtctcgaacacctgggctcaactgatccgcctgcctcggcctcccaaagtgctgggattacaggtgtgagccaccctgctcaaccaggttttattatttaagttagttaaactttggatagattgtataatatatagtttaatgtaatcatgctcatattttttaaataaataaaacactatacta

SEQ ID NO: 33982 - DNA, 2072 bp, Homo sapiens
aatcgtacgccacgcggagagcatgctgggggccggaaggaagaggaaattccagtagccgatcaggagtctgcaaactccggtggtaggggagcgcgctgctgtttagagccacgagttaccggagcgcctgattcctgcgccgaagtcagtggtggccgaaagtccggagtcgctgtaaaacctgagattgtgagccatggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggagacgaggaggatggcgaggaggaggaggaggaggtgctagccctagatatggacgatgaggacgacgaagatggagggaatgcgggggaggaggaggaggaggagaatgccgatgatgatggtgggagctccgtgcaaagtgaagctgaggcctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggtgtcgcctgggttgaggcctttgcaaaaccagtgcctcaggtagatgaggctgagacacgggtcgtgaaggatttggctaaagtttcagtgaaagagaagctgaaaatgttgcgaaaggaatcaccagaactcttggagctgatagaagacctgaaagtcaagttgacagaggttaaggatgagctggagccattgttagagttggtggaacaagggatcattccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccaaaattagaagaagaggccaggttcgtgaagttcgtaaagaagagcaacgttatagtggtgaattatctggcattcgtgcaggagttaaaaagagcattaagcttaaatgaagtttttgcttagcataaggtttttggcagttttggatcaataaatttttacttttaactaaagtcattgtattaatatataatactttaaattttaaaaattcttgtccacaaggaaatttgtctgggttattggacaatttataagaactatgggagcaatatgaaggtgcttgagaaaagagatgatgttgaagttttccaatattctgttgaagttttccaatattaagtattagcttagggaaatttcacagttcattgtggagtgttaaacttagaacatgtgtaacttttcacataaagagaatgcatctttgacagttatcttatttgtaaggcagcctataaaatagttctgaagtattttatttacctaactataattattgggccagatacttgttaataaatgggcttaatgttaacatgg

SEQ ID NO: 33983 - DNA, 753 bp, Homo sapiens
agattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagaccccctcacaatctcctcaactgtttcatgatgacacccattcaagaatagaacaatatgccacacgactggcccagatggaaaggactaatgggtcttttctcactgatagcagctccaccacaggaa

SEQ ID NO: 33984 - DNA, 579 bp, Homo sapiens
aactctaagcttggggccctggagagaacagttgtggcctgcaggtcattagtgaggtgagcagaagggaatcctggacttcccagagaaagaggagaccatgccagcctcgtggaacacagctaccaggaaatacagaagcaggtctattccttgcgaactccgaagtccatgaaaaaacggacccacagtggggtggctaaaatgtcccagcgcaagctgccgctgctgctgatggaccatagctcaagggcaaggcttgtaaaggattttacaaaggattttaaagtatagccagaaaagatacggtgtttagaagttaaacgctgttgtctgaaggaagtttgccggaaagatgtaggcttcaagggctactggacaatgattggtctgaacttcaacttacgggaactgctgacaaaatttgaaaaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgac

SEQ ID NO: 33985 - DNA, 3220 bp, Homo sapiens
caacttccttcatttctggccatgccgggctgagcaagtgctgcctgtgagcatctgctggggggctttctctgtggcgtttgtctgtgttttttaaattgagaagttgaaggaataccagcctcctttttcctagaacctaaccccctgtatctttcaaatgctttcctggaaacgagcatgctcagagaactgacaaatcattgtccagtgaccgggaggaaatgatcgttgctcttcatttataatgcaaattctgaggtgtctccagaagtgtggtaaacttaaaatgatggctgtggtgagaacgtctctgcagaaagttgtggttttgttgcatcgcttacaaaggatggcagtttcttctcctcggtatcagaagctctgtaaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtatt

SEQ ID NO: 33986 - DNA, 3674 bp, Homo sapiens
agccagccgcccggcggggaacgtgcttgacctctgggtggttgctgctcccaagggtggggctccggagagtgtggcgcgatcgccaagctccctggcagcggccctggagagactgaggggacaggaggaggggggcgccccattggtgtgtagtcccgcgcagtcgccggctctccttttccggactctggggatctcttgctgcaactgacaaggtattgatgtcaagctgaaccatcgtaggaagttgaaagccttagaaagaggacttggtaaagtttttggattatcttgaaactctggcaagatggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctg

SEQ ID NO: 33987 - DNA, 12339 bp, Homo sapiens
atggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacattggcacagaatttgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaa

SEQ ID NO: 33988 - DNA, 678 bp, Homo sapiens
aagattatgaagcaacaacactagctacagtttaaatgaaggcatttcttcacttttaatatatttcttttttcaccagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagaccccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggaga

SEQ ID NO: 33989 - DNA, 569 bp, Homo sapiens
aaaaaaaaaacccaaaataacacaggacatcccagtgtgcagttcgaaggctgcttttgttgtccacttcctccacatctttttcctcatcatctaagcagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtggatgtcatgaaggatgtcatgtcggacctgcagcag

SEQ ID NO: 33990 - DNA, 666 bp, Homo sapiens
aagattatgaagcaacaacactagctacagtttaaatgaaggcatttcttcacttttaatatatttcttttttcaccagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgt

SEQ ID NO: 33991 - DNA, 354 bp, Homo sapiens
caccaaactaacactcgcacacacccccgcggttactccgtgtcaaactcctagaggagcccttggccagctcggggtgcggcggtggcgaccggcaggcgaggaggcccgcgggcagcaggtattgatgtcaagctgaaccatcgtaggaagttgaaagccttagaaagaggacttggtaaagtttttggattatcttgaaactctggcaagatggccaagtatggagaacatgaagccagtcctgacaatgggcagaacgaattcagtgatatcattaagtccagatctgatgaacacaatgacgtacagaagaaaacctttaccaaatggataaatgctcgattttcaaag

SEQ ID NO: 33992 - DNA, 633 bp, Homo sapiens
gtgaagtagagtgagcattagcctggcagacagctagggtaatagatgacttccagtggaagtcaaagcacaaatgttggaagaagaagaatggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagaccccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaag

SEQ ID NO: 33993 - DNA, 495 bp, Homo sapiens
atgattggtctgaacttcaacttacgggaactgctgacaaaatttgaaaaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaac

SEQ ID NO: 33994 - DNA, 806 bp, Homo sapiens
agattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagaccccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggagga

SEQ ID NO: 33995 - DNA, 4123 bp, Homo sapiens
aatgagcgctccgggtctcagcggggtggaggggttgcactgcggtaatatggctcttccttagccagcggcggcaacggcggcagcggcggcagcggcggcggctactgtctgggctgagcagtagtgcctctcgggtggcgggtttctaggctgcaggggcttggtaggtggtggcaagggggcggcggcggatgccggaagagtgcccgccccgccgcttggcggcccctggatcgagatgagcgcctccgcgtcggtcgggggccccgtcccccagccacccccgggcccggccgctgctctgcctcccggttctgccgcgcgggccctgcatgtggagctgccgtctcagcagcggcgtcttcgacatcttcggaacattgctgcccggaacattgttaatagaaatggccatcagctccttgatacctactttacacttcacttgtgtagtactgaaaagatatataaagaattttatagaagtgaagtgattaagaattccttgaatcccacgtggcgaagtctcgattttggaattatgccagaccgtcttgatacatctgtgtcttgtttcgtggtgaagatatggggtggaaaggagaacatctaccagctgttgattgaatggaaagtctgtttggatgggctgaaatacttgggtcagcagattcatgcccgaaaccaaaatgaaataatttttgggctgaatgatggatactatggtgctccatttgaacataagggttattcaaatgctcagaagactattcttctgcaggtggatcagaactgtgttcgcaattcttacgatgtcttctctttgctacggcttcatagagcccagtgtgcaattaaacagactcaggtaactgttcagaaaattggaaaggaaattgaagaaaaactaagactcacatctacaagcaatgaactgaaaaaaaaaagtgaatgcctgcagttaaaaattttggtgcttcagaatgaactggaacggcagaagaaagctttgggacgggaggtggcattactgcataagcaacaaattgcattacaagacaaaggaagtgcattttcagctgagcacctcaaacttcaactccagaaggaatccctaaatgagctgaggaaggagtgcactgcaaaaagagaactcttcttgaagactaatgctcagttgacaattcgttgcaggcagttactctctgagctttcctacatttaccctattgatttgaatgaacataaggattactttgtatgcggtgtcaagttgcctaattctgaggacttccaagcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtttccactgtatccaaaaggaggggagaagttgcagtttgattatggtgtctatcttctgaacaaaaatatagcacagctaagatatcaacatggactagggactccagacttgcggcaaacccttcccaacctgaaaaacttcatggagcatggactaatggtcaggtgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttgaaagagcttacagctcgagtcaccttttagctatttgtctgctttttatttacccttgtatgttatcctcagagggaagatgataatatataaataatataatgaacacacccttagtttctcataagcatttgccctcaccatggtttataaaactttgggaaaacggaatattcagaaataggtttccgccatgtactgaaaggtctgtggccatctgtgaggtagatgaagaagcagcatagtggtctccttacatctaggcctaactgtccctcttcctgcccccgggtaccacagtccacctttagaccctactgtcgccccatcttctccgtggatgggccatgcgtcctgaaaacaggacatcagattcactggttctgtaacccagtagctgtgacgttccatctcttctaaccagccatggccttcccctcctctgccatacccttaatgcggccctcagattagatgaaaaacttgctcctggtggatcccaagggaccctcaaggacctcgaggttactgcagtcagatgccatctcatcccctgtgggggccaaagtttttatgtgggcagatgctgtggtcaggaactaggcatgctttctggcaatgcactcaccagacaaaaatcccttgatgtaaatcccatgttaatttattaaatttcagtcagaaggtcagcatttacatgacagaatgtatgtagagagttggggtgtctggtaggcaaactgcaaggcagttgagatagttggattaagaggctagacgagacatagaatactattggtatgtgtgcaatttcatgaatattaaattatgtttcgaagtccagttgtcattcccgcattcagatttcatttgctgttgctttatacgttacgtacccaaggacattgcctcagggttgcaaactctttaaaggaaaatttatccatatatccatgtattatatagaagaataaaaattgagtttacttcacccgacctgatttttttttaccagcttggaaattcctcttgaacctacgtctccatatgtcacatcatgacaggactagcctgaacaaaagccatgtctatctaagcggaggctgttgacttcattcagtttgcatattgtatatagcaacacaaacacttgacaggtatatactccagtcgccacatttgtcctgcataacagcttcactcacaggcctcaccgtcactttattttgtgtccaagcattcctgggctcaagtttaatgtatagctacattgttgttttccatgtagagaactcacaggatgactacatcacaaataaacccaactctcaggcagtcgaaagctttaactggatctgcagaagcccatcttcctccacatgaagaagtggggctccttcacctagagcaggagcttctctgcagtgtactgtctgtcgctcattttggagtcagtgtgggtggagacagcatcgtggatatgcacgtgctgcggggccctccagggaagtaacatttaccaaaaaaaaagaaaa

SEQ ID NO: 33996 - DNA, 1312 bp, Homo sapiens
caccttcacagctaagatatcaacatggactagggactccagacttgcggcaaacccttcccaacctgaaaaacttcatggagcatggactaatggtcaggtggacatctgctttacaagaacacagcaaactaagaaagggtatagtggccactgcgggcaggggcactgattcaaccacccacagcgccagaggggactcgaagaacccacgccaggcttacctccagacctgcgtcctacagaacagacaccactgaacatcctgtagtccccttattgtgtcatcgctcagtaatgttcatatcagtggcccagaggcaacgagaaaatgccttttcttgttcaacttttttaagatgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttg

SEQ ID NO: 33997 - DNA, 1615 bp, Homo sapiens
aactggaacggcagaagaaagctttgggacgggaggtggcattactgcataagcaacaaattgcattacaagacaaaggaagtgcattttcagctgagcacctcaaacttcaactccagaaggaatccctaaatgagctgaggaaggagtgcactgcaaaaagagaactcttcttgaagactaatgctcagttgacaattcgttgcaggcagttactctctgagctttcctacatttaccctattgatttgaatgaacataaggattactttgtatgcggtgtcaagttgcctaattctgaggacttccaaggcatgatttcttggaaaggagagtccatatgtcaaacaatgtctcattgagaacatggaatgattccatagatgctgtggcagtgattagagtcttaaatattttgtcctgtctggatcagtgggtgcttggttccttaacaaatcagctgcctcagtgattgggaaggcaggatgcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtttccactgtatccaaaaggaggggagaagttgcagtttgattatggtgtctatcttctgaacaaaaatatagcacagctaagatatcaacatggactagggactccagacttgcggcaaacccttcccaacctgaaaaacttcatggagcatggactaatggtcaggtgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgac

SEQ ID NO: 33998 - DNA, 6939 bp, Homo sapiens
aattggctacgggaggggagccccgcctcaggcctgtcgacgtctgctgcccggggcccgcaggtggcaggcaggtggggctggtacagcccgcgccgcctctgctgcagccgctgccgtctactccttgcgcgctggcactccgcagcctttaaggttcgcgcgggggccaggcaagagttagccatgaagagcctcaagtcccgcctgaggaggcaggacgtgcccggccccgcgtcgtctggcgccgccgccgccagcgcgcatgcagcagattggaataaatatgatgaccgattgatgaaagcagcagaaaggggggatgtagaaaaagtgacctcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatacgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttctattggtaggtttttttttaaaattagatgaatatgttagtctttttcaatatcagtttgaatcttattttctgtatgtgttaattttacaaataggcaaacaacataactttgccctggattgactacatatttttaaaccttcaagtccctaataaaacatgagccatctgagtgagtccatatgaagcgaggttaggctgaaataattgcttaaagatgtctttcagagaaattaatttggttggtggccacttttaggtggatcaaaagacctttcagatcctcagaaccttgagacataatacagttgtgaggaatgtgttgtaacttggctggccaagttacatgttacagtatctttactgaggtaacttcattagtgtctttggccttttttgtaggtatagatattttttctttttacactaataacttttatgccttttaaaataaatttattttcataaatggtttgcagtgctaaattacatttagattaagaacaggcaggggtggaatatatcaggaatttataataaaattgccttaatctctacaacagtatcttaatttttacttgcggtgactattcttgccacaatattggagaataatgatagatgatatactagatttttcaaagtgtgaaaacctttagactttttttagcaattagtttgacattcgctactatagtaaccaagcactcattatatatgcatcctccaaatgtttcatgcttatttataggaaagttatattaatgagattaataatgtgaaatacagttttcctgcaaaattagcattagagaattgattttagataacagatttttaaagttttagagaaaagtacagtaatacagtaaactgaaagagtatatagatagcaataaaataacataagtggacatgtttatagtaaatactctgaagtaaacaaccgtttttattaactgcatctcattagggaaagtttatatgtcttgttattttttattaacattttatttaccattcagagtgaaaattactaatttgagtattaacaaataactgaataaatggatcattacagttaggttttctcaaattgcaaaatttgccttagcaattatctttgaacatcccgaaccagatttttaaatcccatttttgtttaatagggtaaaaataccatcaaaatgacttctcataccaaagaataagccatcatattttttcggtgttgaaacaacattgaaagtcagaattggatttgtttttaattctttatacggtttacataagcaatatctgtctctttaattattatgattaatgtcgtccttcagcatgagttctgtttcacaagttttgggccacctatttcaataaaaaataaaatataaattaaaaaagttgccgggggtggtggctcatgcctgtaatcccagcactttgggaggctgagggaggtagatcacctgaggtcagaagttcgagaccagccttaccaatatggtgaagccccatctctactaaaaatacaaaaattagccctgcatggtggcaggtgcctgtagtcccaggtactcgggaggctgagacaggagaatcgcttgaacctgggaggcggaggttgcagtgagccaagatctcgccactgcactccagcttgggcaatagcaagactccatctcaaaataaaataaaataaaacttagagcaaagtttaaaactgagtattcatattaagtgttttattttccatattagagatgggaagggaaccttatgtgtattttattttgttttcaaccatcaataaagttttctctagaatattgttttgaacatccttgtaaaagatttgcgagttaaactattttatttactgtctgtgagagcattgggagtaggaaacgatggactccaaagtacaagggagaatacccattttcattcagctatctggagtaaaatatcaagtacttccttcaactaatcttgtctcattcactcaccttttgatatcgaaggcagaaattgcgtttacaacactgaagaccaaagctttttaattagtaaacaagcggaacatagataatggacaatgctggccactgccattctgtgttcagaaagactatgagacctgaacatatggccaagaggaaagaagagtgacgttgtctaagatgtaatgagtgctctctgagagaatcactcaattcctattggagtgcaatccttacttgagaactttattactcttgttctgtgtagttttttttttttgtcacttccccatcagaaaagcatattctttttgatagagggtcagtgttataaataattgtcttttgaaataaaatcaaatattcatgcattgaa

SEQ ID NO: 33999 - DNA, 7078 bp, Homo sapiens
gtgttgaggcagcaggatgcagagtgctgttcaagttttccagtggggtccctcaaagggacaactttgaaagatagctagcttccaaagaataagaaatagatagagttactgtacctgacttggggctgctcttaatcaagttctgcattgcaaggaagataatattcgagcgttatgaaggcggagaaggatcctgaagacgaagaaaatatcgttagagatccaagctaagtgtagcacagcatgtgagggactgagtcacttgtcaggagtttgtctgagagtttgctttgtgagcttacagagatttgtaacttaatgcaaagtagtttgccattagcaacaagaaactaaatcctgtctatgatgaactgttggttttcttgtactcctaagaacagacatgcagcagattggaataaatatgatgaccgattgatgaaagcagcagaaaggggggatgtagaaaaagtgacctcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatacgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttctattggtaggtttttttttaaaattagatgaatatgttagtctttttcaatatcagtttgaatcttattttctgtatgtgttaattttacaaataggcaaacaacataactttgccctggattgactacatatttttaaaccttcaagtccctaataaaacatgagccatctgagtgagtccatatgaagcgaggttaggctgaaataattgcttaaagatgtctttcagagaaattaatttggttggtggccacttttaggtggatcaaaagacctttcagatcctcagaaccttgagacataatacagttgtgaggaatgtgttgtaacttggctggccaagttacatgttacagtatctttactgaggtaacttcattagtgtctttggccttttttgtaggtatagatattttttctttttacactaataacttttatgccttttaaaataaatttattttcataaatggtttgcagtgctaaattacatttagattaagaacaggcaggggtggaatatatcaggaatttataataaaattgccttaatctctacaacagtatcttaatttttacttgcggtgactattcttgccacaatattggagaataatgatagatgatatactagatttttcaaagtgtgaaaacctttagactttttttagcaattagtttgacattcgctactatagtaaccaagcactcattatatatgcatcctccaaatgtttcatgcttatttataggaaagttatattaatgagattaataatgtgaaatacagttttcctgcaaaattagcattagagaattgattttagataacagatttttaaagttttagagaaaagtacagtaatacagtaaactgaaagagtatatagatagcaataaaataacataagtggacatgtttatagtaaatactctgaagtaaacaaccgtttttattaactgcatctcattagggaaagtttatatgtcttgttattttttattaacattttatttaccattcagagtgaaaattactaatttgagtattaacaaataactgaataaatggatcattacagttaggttttctcaaattgcaaaatttgccttagcaattatctttgaacatcccgaaccagatttttaaatcccatttttgtttaatagggtaaaaataccatcaaaatgacttctcataccaaagaataagccatcatattttttcggtgttgaaacaacattgaaagtcagaattggatttgtttttaattctttatacggtttacataagcaatatctgtctctttaattattatgattaatgtcgtccttcagcatgagttctgtttcacaagttttgggccacctatttcaataaaaaataaaatataaattaaaaaagttgccgggggtggtggctcatgcctgtaatcccagcactttgggaggctgagggaggtagatcacctgaggtcagaagttcgagaccagccttaccaatatggtgaagccccatctctactaaaaatacaaaaattagccctgcatggtggcaggtgcctgtagtcccaggtactcgggaggctgagacaggagaatcgcttgaacctgggaggcggaggttgcagtgagccaagatctcgccactgcactccagcttgggcaatagcaagactccatctcaaaataaaataaaataaaacttagagcaaagtttaaaactgagtattcatattaagtgttttattttccatattagagatgggaagggaaccttatgtgtattttattttgttttcaaccatcaataaagttttctctagaatattgttttgaacatccttgtaaaagatttgcgagttaaactattttatttactgtctgtgagagcattgggagtaggaaacgatggactccaaagtacaagggagaatacccattttcattcagctatctggagtaaaatatcaagtacttccttcaactaatcttgtctcattcactcaccttttgatatcgaaggcagaaattgcgtttacaacactgaagaccaaagctttttaattagtaaacaagcggaacatagataatggacaatgctggccactgccattctgtgttcagaaagactatgagacctgaacatatggccaagaggaaagaagagtgacgttgtctaagatgtaatgagtgctctctgagagaatcactcaattcctattggagtgcaatccttacttgagaactttattactcttgttctgtgtagttttttttttttgtcacttccccatcagaaaagcatattctttttgatagagggtcagtgttataaataattgtcttttgaaataaaatcaaatattcatgcattg

SEQ ID NO: 34000 - DNA, 6679 bp, Homo sapiens
atgatgaactgttggttttcttgtactcctaagaacagacatgcagcagattggaataaatatgatgaccgattgatgaaagcagcagaaaggggggatgtagaaaaagtgacctcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatacgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttctattggtaggtttttttttaaaattagatgaatatgttagtctttttcaatatcagtttgaatcttattttctgtatgtgttaattttacaaataggcaaacaacataactttgccctggattgactacatatttttaaaccttcaagtccctaataaaacatgagccatctgagtgagtccatatgaagcgaggttaggctgaaataattgcttaaagatgtctttcagagaaattaatttggttggtggccacttttaggtggatcaaaagacctttcagatcctcagaaccttgagacataatacagttgtgaggaatgtgttgtaacttggctggccaagttacatgttacagtatctttactgaggtaacttcattagtgtctttggccttttttgtaggtatagatattttttctttttacactaataacttttatgccttttaaaataaatttattttcataaatggtttgcagtgctaaattacatttagattaagaacaggcaggggtggaatatatcaggaatttataataaaattgccttaatctctacaacagtatcttaatttttacttgcggtgactattcttgccacaatattggagaataatgatagatgatatactagatttttcaaagtgtgaaaacctttagactttttttagcaattagtttgacattcgctactatagtaaccaagcactcattatatatgcatcctccaaatgtttcatgcttatttataggaaagttatattaatgagattaataatgtgaaatacagttttcctgcaaaattagcattagagaattgattttagataacagatttttaaagttttagagaaaagtacagtaatacagtaaactgaaagagtatatagatagcaataaaataacataagtggacatgtttatagtaaatactctgaagtaaacaaccgtttttattaactgcatctcattagggaaagtttatatgtcttgttattttttattaacattttatttaccattcagagtgaaaattactaatttgagtattaacaaataactgaataaatggatcattacagttaggttttctcaaattgcaaaatttgccttagcaattatctttgaacatcccgaaccagatttttaaatcccatttttgtttaatagggtaaaaataccatcaaaatgacttctcataccaaagaataagccatcatattttttcggtgttgaaacaacattgaaagtcagaattggatttgtttttaattctttatacggtttacataagcaatatctgtctctttaattattatgattaatgtcgtccttcagcatgagttctgtttcacaagttttgggccacctatttcaataaaaaataaaatataaattaaaaaagttgccgggggtggtggctcatgcctgtaatcccagcactttgggaggctgagggaggtagatcacctgaggtcagaagttcgagaccagccttaccaatatggtgaagccccatctctactaaaaatacaaaaattagccctgcatggtggcaggtgcctgtagtcccaggtactcgggaggctgagacaggagaatcgcttgaacctgggaggcggaggttgcagtgagccaagatctcgccactgcactccagcttgggcaatagcaagactccatctcaaaataaaataaaataaaacttagagcaaagtttaaaactgagtattcatattaagtgttttattttccatattagagatgggaagggaaccttatgtgtattttattttgttttcaaccatcaataaagttttctctagaatattgttttgaacatccttgtaaaagatttgcgagttaaactattttatttactgtctgtgagagcattgggagtaggaaacgatggactccaaagtacaagggagaatacccattttcattcagctatctggagtaaaatatcaagtacttccttcaactaatcttgtctcattcactcaccttttgatatcgaaggcagaaattgcgtttacaacactgaagaccaaagctttttaattagtaaacaagcggaacatagataatggacaatgctggccactgccattctgtgttcagaaagactatgagacctgaacatatggccaagaggaaagaagagtgacgttgtctaagatgtaatgagtgctctctgagagaatcactcaattcctattggagtgcaatccttacttgagaactttattactcttgttctgtgtagttttttttttttgtcacttccccatcagaaaagcatattctttttgatagagggtcagtgttataaataattgtcttttgaaataaaatcaaatattcatgcattg

SEQ ID NO: 34001 - DNA, 4723 bp, Homo sapiens
atcatgcactgcagcgtctgtgttgcagtgttgaggcagcaggatgcagagtgctgttcaagttttccagtggggtccctcaaagggacaactttgaaagatagctagcttccaaagaataagaaatagatagagttactgtacctgacttggggctgctcttaatcaagttctgcattgcaaggaagataatattcgagcgttatgaaggcggagaaggatcctgaagacgaagaaaatatcgttagagatccaagctaagtgtagcacagcatgtgagggactgagtcacttgtcaggagtttgtctgagagtttgctttgtgagcttacagagatttgtaacttaatgcaaagtagtttgccattagcaacaagaaactaaatcctgtctatgatgaactgttggttttcttgtactcctaagaacagacatgcagcagattggaataaatatgatgaccgattgatgaaagcagcagaaaggggggatgtagaaaaagtgacctcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatacgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttctat

SEQ ID NO: 34002 - DNA, 6910 bp, Homo sapiens
ctctttacacagaacagtttaacttttgtgcttctgggcagaggtatggtccttgggacagttctccttccacctaatagttatggcagagatcaggacacttcactttgctgcctgtgcactgaggcctcagaatctgctctacccgacttaacagatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacggggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaagtacctcagatccctgagttctcacgtttacagtttcatctcaaaaataagaagcaaaccacataagtataggagaggtaaattaagtgggggcaaggcagtagtggacagggttggaaactgcactggaaaatagggaacatgtgtatgtcataaggaaggcaatgcagcccatccctacctggaatgctgggaagtgctaggcagggctgctctcagcaagactgcagcagctgcacccagacctggggctctggtaggtactaatggtgattatgctccaatttacctaatgaatttggtgggacagcagaaaagaaagctgggaatgtaccaagagaaatttttgttcagggctgttggaagtagctgttagccttgcttccacaaggccattgctgctgtaataagaactgcaaatcagagtgctacaacataaaactgggaaatatggccctatctgaatgcctctgtcctattttccgctggtgtatcagttagtgcaggaagtaaagaatgctggaaagttgaatcagaaattgaaaaccttctaaaatcttacacagattagcagaagtcacttctcccagtctggtatattatttcataatggaccaggatcggcttcctgcctgttggtggctatctgtaaaccataagtacaggggtctccctagtggttcttctctgtcttttgctgggcaggctgtcttcctttattcctggtagcattcagagcattaaccagtgttgattttgaaaatagtagtccctacaggttctcacaaaggaatgaatcctgttctgatacagttcccctgcatactgacatactggccaaggacttgagcagctgtgtatttttctttatcaactaaaataccagggagatggtcttttcttgaaacccagtggcctgtatgtgactgagaggaaaagctggcttggtcctaatggctgtttctctgtacctttcccttcccttaccaccttaagcccaatccaggtagagaatagggagaggcattctcctctctatggatttgaagtgaatcacccccacattattctcacatgcttttcttctctcacatattcctccctactcccccacccaatcattgtgcttatttgtacagatcttattgggaatattctttatttattttgtcatttcacttctattttaagaatgcataattgaaggagtagtcattttcagggagcaccaggtagaccctgggaacctaatgacttaatccttaaatatgttttgcccttgaaaaataggccttttccttccttccttagttataattgtggaagctaattaggatggcatggaagtgaatctaatgagttaggtattattaatgttcttggtatcgggtctaattccagttactgcttcattctctttttaaagctttatgaatacttcccccatcctccccaaggagagctcaatacacacatatttttattttattctctcaaaggaatattagcttaggaagataggaattcaacattgagcactgagttttcttctggctctgtcattgatacactgtcaaaccacagcctcatctcttaatctatttaattaaggtaacagtacatgttctcaagggtgttgcaagtaagtgtgcagctatcccttggagagcctctctggaaagctcttttagtgcagtgttgttatgctgaattgttttccattatcttatttgctgagtagaaaatattaatgaaattaagaattgttgagattatatgaattgggctagaatactaaggggaaaactatgttttgaatagagtttggcatttttgaccaagaacaaaattgagttttcattggaaagaaaggaaaccttgattcttaccattgctgctccaaaggaggcccaggttaagaggattagaggagacacgcggtgctgggcattcctggcaggtgttgggtgatccccgcagtatgtcacctgcagttgcagcacaggcagctagtgattgggttcatctcctcctagtggttggaagagaactcagatgtaaaaaccagcggtccttctcccaccttctttcctgccattcttgctcatcatacatgtccgtaaacttgaagaactcgttttagcagctagccttttaaggtcgaggatgggaaagctaaaactgtagaatattattatgctgctttttaggtttatccctgttgttgtgggatgcaagttaagggattgtaattgtttttcagggtttttttgttttttgttttttaagcaagggctctattttcccttgagagttctggaactaagccttggagaaacactactgagtgtatttaggctccctggttttcttgcccaacaacaatctgaagggtagggggtgggggctgtgtcttactcaggggcagcacctagctgtcttgcctacagtgggtgcacgatatataaatggaattgatttttgtcaacactgtcaagagtggcattgactattggagcataccccgtccacatgatgcttgaactatgtaacttcaggggttgagggctcaaggttcaggttaaagaggcactgtcaacttactatacaagcataatttaggtttttcctttttctacttgaaaaggaccagcttaaacacaaacccttatgtaaattaaaaggtttgaatccaaagcagagagaactgcttctggaaaagtgtagtttaattttaactattctaaaagcaatgagcaaaggcccttgtccaaggcgttgacagttttctaaagtggttatgctgtatatctggatgcatgcctttgggctgccactgcttgattcctttcatgtacagataatattacttcagtttagatttcccactttaaaatgcagtgatttgtgttgaatacatcttgattgtgctttacctaaagtattttcttaaaaggctttgtgtaaaatttaaatgtatatattttcctgtagacttccatcatgattttcagagattagccttaaaaaatttggccctaagaaattcattcagtgtttttctagatgacctctgtacatagaggtcattatagtggagaccctttaccagcagcattttaagatttaaattagatagaaagtttcttaggattcaactgaaaattggctagtaaaatatgtcccaggtaataaagcatgctgactttgctaaggcactgcccatttttatttaactaaagtcatggagattttgagtttaaaggatgcagtatagatagtggtttagtgtttaggctctaatgccagtctaaaaggcaagtcatttaaccttgggagcctcagtttcctcactgtaaaacagggataataatagtaactacctcagggttgttgtaaggattaaatgagatgatatttgtaagatacttagctcaagtgcctggcacacaatgagcacactctataaatgttctactactactattattaacacctagtctagggatgcacagcagaatcccctagggttaaaaaacaaaacaaaacaa

SEQ ID NO: 34003 - DNA, 2140 bp, Homo sapiens
gctcggtggtttaaagatggcggcggcggtggcggcggcggcggcggcggcgttgggggcgcggagccgcgacaggaggagggaaaagcagaatctgtgagtcgcctggaggcagcgcggcggctgccgtgaggaggccgggtgcggagccgccggtggcccagccactcagggccagggcctgggctgggagggagagaccggagcagcgccaggagcccgaggccggagccgaggaggaatgtgaccaggggtcggcgggggcgcgggagtacgcgagagcagggatggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatgaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagttctcctacattgtgccaatcagacgtgcataacattgtgaaccaaaagacacagagcaggatgatgctagcaacgtattcatagtaactccaaactggaaacaacctaaacatccatcaagaggagaacaggtggattgtggtatattcacacgttggcatgctacacagcaatgagaacccctgccacatgcagcagcgtggacgaatctacacacatgatactgggcgaaagaagccagacaaaagagtacatactttatga

SEQ ID NO: 34004 - DNA, 11831 bp, Homo sapiens
atggtccttgggacagttctccttccacctaatagttatggcagagatcaggacacttcactttgctgcctgtgcactgaggcctcagaatctgctctacccgacttaacagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaagtacctcagatccctgagttctcacgtttacagtttcatctcaaaaataagaagcaaaccacataagtataggagaggtaaattaagtgggggcaaggcagtagtggacagggttggaaactgcactggaaaatagggaacatgtgtatgtcataaggaaggcaatgcagcccatccctacctggaatgctgggaagtgctaggcagggctgctctcagcaagactgcagcagctgcacccagacctggggctctggtaggtactaatggtgattatgctccaatttacctaatgaatttggtgggacagcagaaaagaaagctgggaatgtaccaagagaaatttttgttcagggctgttggaagtagctgttagccttgcttccacaaggccattgctgctgtaataagaactgcaaatcagagtgctacaacataaaactgggaaatatggccctatctgaatgcctctgtcctattttccgctggtgtatcagttagtgcaggaagtaaagaatgctggaaagttgaatcagaaattgaaaaccttctaaaatcttacacagattagcagaagtcacttctcccagtctggtatattatttcataatggaccaggatcggcttcctgcctgttggtggctatctgtaaaccataagtacaggggtctccctagtggttcttctctgtcttttgctgggcaggctgtcttcctttattcctggtagcattcagagcattaaccagtgttgattttgaaaatagtagtccctacaggttctcacaaaggaatgaatcctgttctgatacagttcccctgcatactgacatactggccaaggacttgagcagctgtgtatttttctttatcaactaaaataccagggagatggtcttttcttgaaacccagtggcctgtatgtgactgagaggaaaagctggcttggtcctaatggctgtttctctgtacctttcccttcccttaccaccttaagcccaatccaggtagagaatagggagaggcattctcctctctatggatttgaagtgaatcacccccacattattctcacatgcttttcttctctcacatattcctccctactcccccacccaatcattgtgcttatttgtacagatcttattgggaatattctttatttattttgtcatttcacttctattttaagaatgcataattgaaggagtagtcattttcagggagcaccaggtagaccctgggaacctaatgacttaatccttaaatatgttttgcccttgaaaaataggccttttccttccttccttagttataattgtggaagctaattaggatggcatggaagtgaatctaatgagttaggtattattaatgttcttggtatcgggtctaattccagttactgcttcattctctttttaaagctttatgaatacttcccccatcctccccaaggagagctcaatacacacatatttttattttattctctcaaaggaatattagcttaggaagataggaattcaacattgagcactgagttttcttctggctctgtcattgatacactgtcaaaccacagcctcatctcttaatctatttaattaaggtaacagtacatgttctcaagggtgttgcaagtaagtgtgcagctatcccttggagagcctctctggaaagctcttttagtgcagtgttgttatgctgaattgttttccattatcttatttgctgagtagaaaatattaatgaaattaagaattgttgagattatatgaattgggctagaatactaaggggaaaactatgttttgaatagagtttggcatttttgaccaagaacaaaattgagttttcattggaaagaaaggaaaccttgattcttaccattgctgctccaaaggaggcccaggttaagaggattagaggagacacgcggtgctgggcattcctggcaggtgttgggtgatccccgcagtatgtcacctgcagttgcagcacaggcagctagtgattgggttcatctcctcctagtggttggaagagaactcagatgtaaaaaccagcggtccttctcccaccttctttcctgccattcttgctcatcatacatgtccgtaaacttgaagaactcgttttagcagctagccttttaaggtcgaggatgggaaagctaaaactgtagaatattattatgctgctttttaggtttatccctgttgttgtgggatgcaagttaagggattgtaattgtttttcagggtttttttgttttttgttttttaagcaagggctctattttcccttgagagttctggaactaagccttggagaaacactactgagtgtatttaggctccctggttttcttgcccaacaacaatctgaagggtagggggtgggggctgtgtcttactcaggggcagcacctagctgtcttgcctacagtgggtgcacgatatataaatggaattgatttttgtcaacactgtcaagagtggcattgactattggagcataccccgtccacatgatgcttgaactatgtaacttcaggggttgagggctcaaggttcaggttaaagaggcactgtcaacttactatacaagcataatttaggtttttcctttttctacttgaaaaggaccagcttaaacacaaacccttatgtaaattaaaaggtttgaatccaaagcagagagaactgcttctggaaaagtgtagtttaattttaactattctaaaagcaatgagcaaaggcccttgtccaaggcgttgacagttttctaaagtggttatgctgtatatctggatgcatgcctttgggctgccactgcttgattcctttcatgtacagataatattacttcagtttagatttcccactttaaaatgcagtgatttgtgttgaatacatcttgattgtgctttacctaaagtattttcttaaaaggctttgtgtaaaatttaaatgtatatattttcctgtagacttccatcatgattttcagagattagccttaaaaaatttggccctaagaaattcattcagtgtttttctagatgacctctgtacatagaggtcattatagtggagaccctttaccagcagcattttaagatttaaattagatagaaagtttcttaggattcaactgaaaattggctagtaaaatatgtcccaggtaataaagcatgctgactttgctaaggcactgcccatttttatttaactaaagtcatggagattttgagtttaaaggatgcagtatagatagtggtttagtgtttaggctctaatgccagtctaaaaggcaagtcatttaaccttgggagcctcagtttcctcactgtaaaacagggataataatagtaactacctcagggttgttgtaaggattaaatgagatgatatttgtaagatacttagctcaagtgcctggcacacaatgagcacactctataaatgttctactactactattattaacacctagtctagggatgcacagcagaatcccctagggttaaaaaacaaaacaaaacaaacaaaaaaaactgacggaatagccccactccagatcagaattcccagtgggctggggtctcggccagtgtattctccagtaatctcgccaggtgtttgaaacacccagtgctatctgaaaactatcagtaccccaaccctttggtttatagattaagaaactagcagaagatggttaaattacttgcctattgtctcagaacggttaattagtggcggagccaaggctagaattcaagtctcttgactttatggttgtggggtctttccaccatacctgctgccatgtgagacactgcaaaaaagtggctcagaccgacaatcagcctgtgtggtgctgcacactttctaaagcacatgctcctgacactttgaccttaaggggcttgaatgtggagtaatgggaacacaagccaagcaagcactcagtagaattcagtcatttaaaaaattcaatggggtcattcttttggacagacctcagcaacacagcaatgtgcactttgtagtaaagaaataccaacttgagtttttaaaaaacctagttagtcctacattcccttttctttaaaaaaactttattgttcacattattttaatgactatgagataatgtatatgacagcactttgagaaaatatcaactgtaatataactataaggttgtagtattgtctgtttaaaagataagacagttgattcaatgtggatggaccctgtggggtacctgaaaatgtagatacgtaagaatcacctctgtcatttatcacatttagaaatatgaaactgcttaacaggtatgagcaggtatagcaagtgtttgctaaagttgtagttcagagctgaattacttcaggaaactagggaccaactttttggtttaattccgatctttaaaaagtaagaatgtgtactcactccagaacacagaagctcttccaaggaccttgactcaagaaggatgaggtcctcttactcttctccatttatccactatatgcttggccatttatcctaaatgtggtgggaacagacttgttatctgttgatgttgacagtgtcttttttaacctatgtcctgcatagttttgttaggtttacagggggaggtggatggccataaaaccagtgcactttgggaattacttttctaggatttcctaccagttataaatgacattgacatttgtcatcttttttttctttttctaaaaagaatagctgaatttaattcacctattataaaatactcaaaagtaaattgccttggtggccacttctgaattatagctacatttcattatgaccccttctgctcccttccattttgctactgatgtcattcttgttatcaggctgtgcccctaccaggagttcatattgggttgacagggttatctatatttttgttcttgatttttgagtttcatcatcttgcattaaattgttccacctggatttggggttcatctctgtgccctaaggatctgctatgaccaatcctctttttgtaggtgggtctctggcttaagtattgataggcttcagcggtttgtgtctctgtcttagcttgtatcaagccagtagtagctcacttcctttgtaaattcctgcttcagtctgggatccgtaggagtatgtgagaacttctgaaacgtctccaactcttaacagtcaagatatctatatcatttggatagagttctggttttccaactactagacttaaagaaattctggccgggtgcggtggctcacgcctgtaatcccagcactttggggggctgaggcgggtggatcacgaggtcaggagattgagaccatcctggctaacacggtgaaaccccacctctactaaaaatacaaaaacttagctgggcgtggtggcgggcgcctgtagtcccagctactggggaggctgaggcaggagaatggcgtgaacccaggaggcggagcttgcagtgagcccagatcgcgccactgcactccagcctgggtgacagtgagactccgtctcaaaaaaaaaaaaaaaaaaaaaaaaaaaaaaaaaaagaaattctaatgcaaagcttgctttttttttcttttttccagcaagccagtagtaatagttattgttacttgctctgttcagcacaactgtagttcacttgaacttcactgtcattccctacgctcctctcttactgagaagcatgggtgggattcagggctgtgggacaagctacagcctactctggagcactcacccccatgactcagtccagcctgtctcttgggaagtttattgcaatgtgcagacggatgaatttctgcttttcatgccacctctctgaggtatgtattctatcttgagtatgtacaagatgataccttttggctgggcacagtggctcgtgcctgtaatcccagcactttgggagaccaagatgggcggatcacttgaggtcaggagtttgagaccagcctggccaacatggtgaaaccccgtctctactaaaaatataaaaattagccgggcgtagtacatgcctgtaatcccagctactcccgaggctgaggcagaattgcttgaacccaggaggcggaggttgcagtgagctgagatcgcgccgctgcactccagcctaagtgacagagtgagacacgttaagaagaaaaaaaaaaaaaaggataccttcatttctgactcaatatcctagatccaaaggacaggaaattagggaaggcttcaccctgtgggatcaagataagaagatcccatacttcttcccaggtaaggaggcctgtggcaggtcatgattcaaagctgacttggaatggcagaaactgctgagaggccacccttggagatttgtgccttcaaagatgggtttcatgagtctcagagaggaaaagacttgtcagctgggttgattttgcatgattattgaactagagctggtagacacgagcttctcagatggcagtggccagatcctccatctgtgagaatccgccacttgaagtggtttcctgagagtgttcacttggcagttgctgcgtttctcaagcccacctggcgaggtctcgccggacccttccctccaagtgcacttacttcttcatccccatgtacatctctaactttgaaattgtttacctctcctacaaaaatcttaccttttgacctgagcagagtagcaaagccctgttcactctgagggagcagctggcgtgttgaaggggaaaggccaggcacagcactgtcctcagaccacaccatatttggagcagaattgtgatacatgtcatctgtgtctattctggaaggttctttgttcatcactgtactcgcatcagcaaattttcagggtcctacctgtcactccaggctactgagctgaaccctcagaagctgaggtctccgagcatgctaagtaaccttttagaaaagctggaggcaaactgtcgaatgctagcaggctttatgaaaggaaacataaggagtttgtgtagtcagaacttgcttaaatttgcttcggaattaggcaccataaactttagttggagaatgggacttaaattttcacatatatgtatacttaattttcagcaattatgacacaataaaaagaatatgcaaatttattgttgtttcagaaggttttgcaggactgggaacgctttagtgtcatcaacagtaaacctcagatactgttctgcacagttcagaagtaccataccaggtattgtgagtggcaagaacgccaggggacagagatgcttctggtagatgagggccagagaaaccagctctcctccattttgacagcaatttctcactgtggccatttggcctccattatgttttgagaggaatttcttgagatcttgagaaatcaccatgattaggccaattgtcaatcagtattcagaaactagaaaggaacaatgagatacttgtttatggttctttagggcatatgtttgaaaaccctctcatctcagatctgtatagctggtgtgtgtttgtgtccataaatacacgtgcattgctgtcgtgcccattaagaaagggggagtaagtaaaagaggaatcgctcagatctttccttggatgaacagcagtggcgtggttggtgtgttgactgtgaacaggctgacttagctgttgatgtatactcagaacctccatctcctcccagaccctgcacttttccttctctgcagtctgattctctaatgactgtcactggacaaaccccagttttatgctcgcttagtaaaaataagtttaaacatttcatggtggttgacagaactttgtccccaaacatgcggattcaattctttaaaactcgttgaacgtttataccaaaggtcccgccccgcaggtgtgtatgtggtgcacagagggtgaggtttggagcatcgggcactgtgtgcattgctaaggggacatagtgagacaatgtgggatttaactaaaaacacatcaattgtgtgtcacattaccagtgttgtcaggtatttgttcttaattgttattgtaatatattttcagttgtttttctaatttaattctctccgtctgttgtctgactgtgaactgctaacagtgttaaacttgatgtaaataaatgaggcccttgaaagggactgctttctctgtcttctcacaaggtttgccaagttgtgttctgttttaaataaaggttgcaatattttattggcaaagt

SEQ ID NO: 34005 - DNA, 12144 bp, Homo sapiens
aaaagcagaatctgtgagtcgcctggaggcagcgcggcggctgccgtgaggaggccgggtgcggagccgccggtggcccagccactcagggccagggcctgggctgggagggagagaccggagcagcgccaggagcccgaggccggagccgaggaggaatgtgaccaggggtcggcgggggcgcgggagtacgcgagagcagggatggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatgatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaagtacctcagatccctgagttctcacgtttacagtttcatctcaaaaataagaagcaaaccacataagtataggagaggtaaattaagtgggggcaaggcagtagtggacagggttggaaactgcactggaaaatagggaacatgtgtatgtcataaggaaggcaatgcagcccatccctacctggaatgctgggaagtgctaggcagggctgctctcagcaagactgcagcagctgcacccagacctggggctctggtaggtactaatggtgattatgctccaatttacctaatgaatttggtgggacagcagaaaagaaagctgggaatgtaccaagagaaatttttgttcagggctgttggaagtagctgttagccttgcttccacaaggccattgctgctgtaataagaactgcaaatcagagtgctacaacataaaactgggaaatatggccctatctgaatgcctctgtcctattttccgctggtgtatcagttagtgcaggaagtaaagaatgctggaaagttgaatcagaaattgaaaaccttctaaaatcttacacagattagcagaagtcacttctcccagtctggtatattatttcataatggaccaggatcggcttcctgcctgttggtggctatctgtaaaccataagtacaggggtctccctagtggttcttctctgtcttttgctgggcaggctgtcttcctttattcctggtagcattcagagcattaaccagtgttgattttgaaaatagtagtccctacaggttctcacaaaggaatgaatcctgttctgatacagttcccctgcatactgacatactggccaaggacttgagcagctgtgtatttttctttatcaactaaaataccagggagatggtcttttcttgaaacccagtggcctgtatgtgactgagaggaaaagctggcttggtcctaatggctgtttctctgtacctttcccttcccttaccaccttaagcccaatccaggtagagaatagggagaggcattctcctctctatggatttgaagtgaatcacccccacattattctcacatgcttttcttctctcacatattcctccctactcccccacccaatcattgtgcttatttgtacagatcttattgggaatattctttatttattttgtcatttcacttctattttaagaatgcataattgaaggagtagtcattttcagggagcaccaggtagaccctgggaacctaatgacttaatccttaaatatgttttgcccttgaaaaataggccttttccttccttccttagttataattgtggaagctaattaggatggcatggaagtgaatctaatgagttaggtattattaatgttcttggtatcgggtctaattccagttactgcttcattctctttttaaagctttatgaatacttcccccatcctccccaaggagagctcaatacacacatatttttattttattctctcaaaggaatattagcttaggaagataggaattcaacattgagcactgagttttcttctggctctgtcattgatacactgtcaaaccacagcctcatctcttaatctatttaattaaggtaacagtacatgttctcaagggtgttgcaagtaagtgtgcagctatcccttggagagcctctctggaaagctcttttagtgcagtgttgttatgctgaattgttttccattatcttatttgctgagtagaaaatattaatgaaattaagaattgttgagattatatgaattgggctagaatactaaggggaaaactatgttttgaatagagtttggcatttttgaccaagaacaaaattgagttttcattggaaagaaaggaaaccttgattcttaccattgctgctccaaaggaggcccaggttaagaggattagaggagacacgcggtgctgggcattcctggcaggtgttgggtgatccccgcagtatgtcacctgcagttgcagcacaggcagctagtgattgggttcatctcctcctagtggttggaagagaactcagatgtaaaaaccagcggtccttctcccaccttctttcctgccattcttgctcatcatacatgtccgtaaacttgaagaactcgttttagcagctagccttttaaggtcgaggatgggaaagctaaaactgtagaatattattatgctgctttttaggtttatccctgttgttgtgggatgcaagttaagggattgtaattgtttttcagggtttttttgttttttgttttttaagcaagggctctattttcccttgagagttctggaactaagccttggagaaacactactgagtgtatttaggctccctggttttcttgcccaacaacaatctgaagggtagggggtgggggctgtgtcttactcaggggcagcacctagctgtcttgcctacagtgggtgcacgatatataaatggaattgatttttgtcaacactgtcaagagtggcattgactattggagcataccccgtccacatgatgcttgaactatgtaacttcaggggttgagggctcaaggttcaggttaaagaggcactgtcaacttactatacaagcataatttaggtttttcctttttctacttgaaaaggaccagcttaaacacaaacccttatgtaaattaaaaggtttgaatccaaagcagagagaactgcttctggaaaagtgtagtttaattttaactattctaaaagcaatgagcaaaggcccttgtccaaggcgttgacagttttctaaagtggttatgctgtatatctggatgcatgcctttgggctgccactgcttgattcctttcatgtacagataatattacttcagtttagatttcccactttaaaatgcagtgatttgtgttgaatacatcttgattgtgctttacctaaagtattttcttaaaaggctttgtgtaaaatttaaatgtatatattttcctgtagacttccatcatgattttcagagattagccttaaaaaatttggccctaagaaattcattcagtgtttttctagatgacctctgtacatagaggtcattatagtggagaccctttaccagcagcattttaagatttaaattagatagaaagtttcttaggattcaactgaaaattggctagtaaaatatgtcccaggtaataaagcatgctgactttgctaaggcactgcccatttttatttaactaaagtcatggagattttgagtttaaaggatgcagtatagatagtggtttagtgtttaggctctaatgccagtctaaaaggcaagtcatttaaccttgggagcctcagtttcctcactgtaaaacagggataataatagtaactacctcagggttgttgtaaggattaaatgagatgatatttgtaagatacttagctcaagtgcctggcacacaatgagcacactctataaatgttctactactactattattaacacctagtctagggatgcacagcagaatcccctagggttaaaaaacaaaacaaaacaaacaaaaaaaactgacggaatagccccactccagatcagaattcccagtgggctggggtctcggccagtgtattctccagtaatctcgccaggtgtttgaaacacccagtgctatctgaaaactatcagtaccccaaccctttggtttatagattaagaaactagcagaagatggttaaattacttgcctattgtctcagaacggttaattagtggcggagccaaggctagaattcaagtctcttgactttatggttgtggggtctttccaccatacctgctgccatgtgagacactgcaaaaaagtggctcagaccgacaatcagcctgtgtggtgctgcacactttctaaagcacatgctcctgacactttgaccttaaggggcttgaatgtggagtaatgggaacacaagccaagcaagcactcagtagaattcagtcatttaaaaaattcaatggggtcattcttttggacagacctcagcaacacagcaatgtgcactttgtagtaaagaaataccaacttgagtttttaaaaaacctagttagtcctacattcccttttctttaaaaaaactttattgttcacattattttaatgactatgagataatgtatatgacagcactttgagaaaatatcaactgtaatataactataaggttgtagtattgtctgtttaaaagataagacagttgattcaatgtggatggaccctgtggggtacctgaaaatgtagatacgtaagaatcacctctgtcatttatcacatttagaaatatgaaactgcttaacaggtatgagcaggtatagcaagtgtttgctaaagttgtagttcagagctgaattacttcaggaaactagggaccaactttttggtttaattccgatctttaaaaagtaagaatgtgtactcactccagaacacagaagctcttccaaggaccttgactcaagaaggatgaggtcctcttactcttctccatttatccactatatgcttggccatttatcctaaatgtggtgggaacagacttgttatctgttgatgttgacagtgtcttttttaacctatgtcctgcatagttttgttaggtttacagggggaggtggatggccataaaaccagtgcactttgggaattacttttctaggatttcctaccagttataaatgacattgacatttgtcatcttttttttctttttctaaaaagaatagctgaatttaattcacctattataaaatactcaaaagtaaattgccttggtggccacttctgaattatagctacatttcattatgaccccttctgctcccttccattttgctactgatgtcattcttgttatcaggctgtgcccctaccaggagttcatattgggttgacagggttatctatatttttgttcttgatttttgagtttcatcatcttgcattaaattgttccacctggatttggggttcatctctgtgccctaaggatctgctatgaccaatcctctttttgtaggtgggtctctggcttaagtattgataggcttcagcggtttgtgtctctgtcttagcttgtatcaagccagtagtagctcacttcctttgtaaattcctgcttcagtctgggatccgtaggagtatgtgagaacttctgaaacgtctccaactcttaacagtcaagatatctatatcatttggatagagttctggttttccaactactagacttaaagaaattctggccgggtgcggtggctcacgcctgtaatcccagcactttggggggctgaggcgggtggatcacgaggtcaggagattgagaccatcctggctaacacggtgaaaccccacctctactaaaaatacaaaaacttagctgggcgtggtggcgggcgcctgtagtcccagctactggggaggctgaggcaggagaatggcgtgaacccaggaggcggagcttgcagtgagcccagatcgcgccactgcactccagcctgggtgacagtgagactccgtctcaaaaaaaaaaaaaaaaaaaaaaaaaaaaaaaaaaagaaattctaatgcaaagcttgctttttttttcttttttccagcaagccagtagtaatagttattgttacttgctctgttcagcacaactgtagttcacttgaacttcactgtcattccctacgctcctctcttactgagaagcatgggtgggattcagggctgtgggacaagctacagcctactctggagcactcacccccatgactcagtccagcctgtctcttgggaagtttattgcaatgtgcagacggatgaatttctgcttttcatgccacctctctgaggtatgtattctatcttgagtatgtacaagatgataccttttggctgggcacagtggctcgtgcctgtaatcccagcactttgggagaccaagatgggcggatcacttgaggtcaggagtttgagaccagcctggccaacatggtgaaaccccgtctctactaaaaatataaaaattagccgggcgtagtacatgcctgtaatcccagctactcccgaggctgaggcagaattgcttgaacccaggaggcggaggttgcagtgagctgagatcgcgccgctgcactccagcctaagtgacagagtgagacacgttaagaagaaaaaaaaaaaaaaggataccttcatttctgactcaatatcctagatccaaaggacaggaaattagggaaggcttcaccctgtgggatcaagataagaagatcccatacttcttcccaggtaaggaggcctgtggcaggtcatgattcaaagctgacttggaatggcagaaactgctgagaggccacccttggagatttgtgccttcaaagatgggtttcatgagtctcagagaggaaaagacttgtcagctgggttgattttgcatgattattgaactagagctggtagacacgagcttctcagatggcagtggccagatcctccatctgtgagaatccgccacttgaagtggtttcctgagagtgttcacttggcagttgctgcgtttctcaagcccacctggcgaggtctcgccggacccttccctccaagtgcacttacttcttcatccccatgtacatctctaactttgaaattgtttacctctcctacaaaaatcttaccttttgacctgagcagagtagcaaagccctgttcactctgagggagcagctggcgtgttgaaggggaaaggccaggcacagcactgtcctcagaccacaccatatttggagcagaattgtgatacatgtcatctgtgtctattctggaaggttctttgttcatcactgtactcgcatcagcaaattttcagggtcctacctgtcactccaggctactgagctgaaccctcagaagctgaggtctccgagcatgctaagtaaccttttagaaaagctggaggcaaactgtcgaatgctagcaggctttatgaaaggaaacataaggagtttgtgtagtcagaacttgcttaaatttgcttcggaattaggcaccataaactttagttggagaatgggacttaaattttcacatatatgtatacttaattttcagcaattatgacacaataaaaagaatatgcaaatttattgttgtttcagaaggttttgcaggactgggaacgctttagtgtcatcaacagtaaacctcagatactgttctgcacagttcagaagtaccataccaggtattgtgagtggcaagaacgccaggggacagagatgcttctggtagatgagggccagagaaaccagctctcctccattttgacagcaatttctcactgtggccatttggcctccattatgttttgagaggaatttcttgagatcttgagaaatcaccatgattaggccaattgtcaatcagtattcagaaactagaaaggaacaatgagatacttgtttatggttctttagggcatatgtttgaaaaccctctcatctcagatctgtatagctggtgtgtgtttgtgtccataaatacacgtgcattgctgtcgtgcccattaagaaagggggagtaagtaaaagaggaatcgctcagatctttccttggatgaacagcagtggcgtggttggtgtgttgactgtgaacaggctgacttagctgttgatgtatactcagaacctccatctcctcccagaccctgcacttttccttctctgcagtctgattctctaatgactgtcactggacaaaccccagttttatgctcgcttagtaaaaataagtttaaacatttcatggtggttgacagaactttgtccccaaacatgcggattcaattctttaaaactcgttgaacgtttataccaaaggtcccgccccgcaggtgtgtatgtggtgcacagagggtgaggtttggagcatcgggcactgtgtgcattgctaaggggacatagtgagacaatgtgggatttaactaaaaacacatcaattgtgtgtcacattaccagtgttgtcaggtatttgttcttaattgttattgtaatatattttcagttgtttttctaatttaattctctccgtctgttgtctgactgtgaactgctaacagtgttaaacttgatgtaaataaatgaggcccttgaaagggactgctttctctgtcttctcacaaggtttgccaagttgtgttctgttttaaataaaggttgcaatattttattggcaaagta

SEQ ID NO: 34006 - DNA, 3132 bp, Homo sapiens
atggtccttgggacagttctccttccacctaatagttatggcagagatcaggacacttcactttgctgcctgtgcactgaggcctcagaatctgctctacccgacttaacagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacggggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtag

SEQ ID NO: 34007 - DNA, 3635 bp, Homo sapiens
ctgggcagaggtatggtccttgggacagttctccttccacctaatagttatggcagagatcaggacacttcactttgctgcctgtgcactgaggcctcagaatctgctctacccgacttaacagatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaa

SEQ ID NO: 34008 - DNA, 3486 bp, Homo sapiens
atggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatgaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtag

SEQ ID NO: 34009 - DNA, 3177 bp, Homo sapiens
atggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatgaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacggggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtag

SEQ ID NO: 34010 - DNA, 3240 bp, Homo sapiens
atggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatgatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacggggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtag

SEQ ID NO: 34011 - DNA, 3106 bp, Homo sapiens
agagtcatgtgactcgagtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagctggtccgggagttcgtggcccagaacaataccgtgcaaatcaagcatgtgatccagaccctgtcccaggagtttgccctgtctcagcacccccacagccggaaagggggcctcatcggcctggccgcctgctccatcgcactgggcaaggactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtggaggtccagatggttcctgtgactccagcttcagtagcggcatcagtgtcttcactgcagccagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctcaa

SEQ ID NO: 34012 - DNA, 2072 bp, Homo sapiens
atcttctccagcctggccccagagccatggctggcgttcaggggcatttgggaagctgggcccaggtcatgcggagcggaggctgagtccagcgacctaggaggagatggaggtgtttcaggcctcccaccaagaaatgtggctcacgtcactgagcacccaagacctcggggcctccgacgccgtgttggaactgtggtgatgcttccctggagacgggatgcggcgtcaggcactggagcttagccccagacggaaggtggtgtgggcaggggtgccacgctgccgccagcccagcactcaggaagcgcagtgctgcacaccaccctctcaccagccaccccgctcatgccccatcctgcctgcatcatgctgttttggggaagctcccgaatccctgggactccagctgggaagcattgcccaggtgcccttcccctgcaggccaggcctccaagggcacgtggaaaagcagcgcggattcctccaagcctgtcctcaccacccacttctcactgctcgtgtcatccggcccagggaccctgaggaatctgcttttcttcatcctctgggttccctttttgccttttgtataacagggaggctcctcttcacaaagtccgatccttagccctgaacgactcttaactagacaagagatgggaaaggggtcatggcccagggaccagcgagccctaagtgactctggccgtaagtgactctgcgaccttagtcaagtcacttcaccagagtttcaccatccgtacagtgaagaaaaaactcagggtcataacgctgatcccacacggatctgtgctccaggccgcagggtacagcccgaacagtgcaaatccctgacctcgggggcttccaggaggaggagtggggcagtaaacaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccct

SEQ ID NO: 34013 - DNA, 1745 bp, Homo sapiens
cccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggcgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaagaagcgaaagaaagaaattgaagaaagcaaggaacctggtgttgaagatacggaatggtcaaacacacagacagaggaggccatacagacccgttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacacagt

SEQ ID NO: 34014 - DNA, 1888 bp, Homo sapiens
gggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccgaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaa

SEQ ID NO: 34015 - DNA, 1386 bp, Homo sapiens
gggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccgaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcagatcaggcagctgggatattaa

SEQ ID NO: 34016 - DNA, 2036 bp, Homo sapiens
attccccatgtagccgcgccctctccttcccctgggcgtctccggggcgtggacaggccgctgaaaggaaccggctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcagaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcagtttaggtagaagcttaggctattgatttgaacccactattttttctaatgaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaatagtgtcatagaatagtgtcatagtacagtttggaaaacacttctgaag

SEQ ID NO: 34017 - DNA, 1375 bp, Homo sapiens
ttcgtaccaaactggtctggcggcggttcttcgtccagacgctggcgggccagggtggagaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtattgtctttgtagtcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaagtacaaattttcaagtatttcatcatgtactgcaccaggtctgaagggatacattaaagggagctaacaacacagagaagattggcattcacccaacatgacaaccaaagcaaatttctttagtttgaaaaatatgttttaaaaaaaccaaacaactaacacataaaatccattaaggtaacattgtaaaaagacatgtatttgaattacagtgcaaaatataaagtgaaatatctgttcttttacatggtatttccaaagcttagattctaggtggtagtgttttcaaggaagaatattttcaaattagcattgtacaagtatgttgaagtagtctgagcttggtacgattgatattaactgtgtaaaacagcactatgaaatgggacaaatagggcttatatttttcaagtgagagcaacatacctcttatttctgtcttggaggaagtatgttttctttcttaagaaacaaaatttttacatgagctatttatatgag

SEQ ID NO: 34018 - DNA, 2446 bp, Homo sapiens
ggctattcacacgcttcagttcacaacttccatccagaatcctacttctctgattgtcctcatggggaaagtatgctatttccttcatcctacaagatgcttctcactgactctatccatattcttctcatccttcaagagccaagtcaaatctctctgcttccaataagccttccttgctacactcagaaatggaatgaatccccaagatggcttaaggatgcccttctgttttggaatgctttctcttggtgtatatcaaggttggttcagtttaccagagaaaagatgccagggtctcattctgtcacccaagctggagtccagtgacatggtcacagctcactgaagcctcaacctccttggctcaagcaatcctttcacctcagccttctaagtagctaggagcacagtgtcataaagaagaatatttgaagctctataaatatgttgctttacgtggcaaaaaggactttacagatctgagtacactggattatctgggtgggcacaatgtaatcacaaggggctttctaagaaggaagaaggagggttcaaggcagaaaaaccggaagaagttataacattggctttgaagatggaagatggggacacaagtcaaggaattcaggtggcctctagaagcctgaaaagtcaaagaaatgaattctcccctagagcctcaagaaggaacacagccctgctgacagcttgattttaggatttctgacctccagactaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtacta

SEQ ID NO: 34019 - DNA, 1676 bp, Homo sapiens
gcagctggagagaagttaggcaggtcctagggagggcaggctcgagtgctgggcccgcctccccgcgggactgtaggcccgggggctccgcctcgtcgcagcggcagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagaca

SEQ ID NO: 34020 - DNA, 1100 bp, Homo sapiens
gtccttagccggtagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccc

SEQ ID NO: 34021 - DNA, 2697 bp, Homo sapiens
gagcggtcacgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaacctagcctttaagcaacctggaaagaggctagaacaccaaggaattagaattgaatttgtaggtcaaattgaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaattttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaac

SEQ ID NO: 34022 - DNA, 3229 bp, Homo sapiens
gcgcctttgccctctcagaacggctgggcggaacgaggcgagaaagccaagttaagaaaacccagactcagaaggaggtggagcgggactgcgttcaggcaaggtggcagaacgcctcgccgtggacgaagagagcacatctcttcttgcgaggcctaaggaagtagggctcccactcgcctcggcaacccaaggacccagccaaggagagagcctccagatgaatccttcctctcctccttccttcccagccgctcaaactttcacaaagaggaactgggtgcggtaaagaggccggacacggaaccgctcgtccggtgaccgaagagacggcgaggaggagcccgcgaacccgcctctgttcaggccccgcccactcgacgtaatttgcccgcccctctccaccctccgaagggtggagcctgaggccccgcctccaagcggcctctccccggagtgcctggcggccagcagggcggggcaggaggctgggagagggacgggtgcgggggtgggggagaggaagggagcggtcacgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaacctagcctttaagcaacctggaaagaggctagaacaccaaggaattagaattgaatttgtaggtcaaattgaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaattttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaa

SEQ ID NO: 34023 - DNA, 2554 bp, Homo sapiens
gagcggtcacgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaacctagcctttaagcaacctggaaagaggctagaacaccaaggaattagaattgaatttgtaggtcaaattgaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaattttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaac

SEQ ID NO: 34024 - DNA, 1032 bp, Homo sapiens
gagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaagaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcgg

SEQ ID NO: 34025 - DNA, 1410 bp, Homo sapiens
acgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtactctgtagaggacttgagtacttttgggatgtgtctatgcatggtcagatatgtttatgacgccttctataaggtaaacctagcctttaagcaacctggaaagaggctagaacaccaaggaattagaattgaatttgtaggtcaaattgaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctac

SEQ ID NO: 34026 - DNA, 3691 bp, Homo sapiens
gagctcgcccgccccctcccccgcccggagccgccgaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatccttctgaacgatgcagagagtaggaagcgggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcgaactctactacgatcgcgggaaccaccatgagtttgtgtccctggtgaaggacctggcccggcctggagagatcacccagtcgcaggccttcgactttgagtttacccacgtggagaagccgtatgagtcctacacagggcagaatgtgaagctacgctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaaataccacttgaaagatgtcattgtagggaagatatacttcctgctggtgagaatcaaaatcaagcacatggagatagacatcatcaagcgagaaacgacgggtacaggccccaacgtgtaccatgagaatgacacgatagccaagtacgagatcatggacggggcaccagtgcgaggagagtccatcccgatccggctcttcctggccgggtatgagctcacgcccaccatgcgggacatcaacaagaagttctctgtgcgctattacctcaacctggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtgggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcaccctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcattttgggtagcctaggagggcgactggcggcagcagaaccgaggaaggcaaggttgtttcccccacgctgtgtcctgtgttcaggtgcgacacacaatcctcatgggaacaggatcacccatgcgctgcccttgatgatcaaggttggggcttaagtggataagggaggcaagttctgggttccttgccttttcagagcatgaggtcaggctctgtatccctccttttcctagctgatattctaactagaagcatttgtcaattcctttgcctcccaactgacaacacacgttcattttccaaccttcctaacatcttaaacctttcttctgggagaactagaagacagaatttgctttgattctctcaggcgctgtgcacaagccaggtcttctgttttctctttcttactctacccacattcttgccttctctatccaactgtgaaagtgaggggaggctcctgtccccctctcttaaggtccccaaacctgggagtgcataggtactaaatcaagcagtgcaacttgtaattaagcagctgcagtgtttacatgtttcttaatgtgtcatcttttcaatggctgtattaaaagaagaacgtttgttttaatggtctttctgattaaagaaagcccctgtggctttggaggcattgtgcccacggtccaccaa

SEQ ID NO: 34027 - DNA, 944 bp, Homo sapiens
cgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgaccttc

SEQ ID NO: 34028 - DNA, 1062 bp, Homo sapiens
cgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggtgggtgtccctcccagccaggcagagccccgcagtgcccgagaccctcccagccaggcggagccccgcagtgcccctgaggccctcagcccccacatgccctgtgctgcactcccaggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgaccttc

SEQ ID NO: 34029 - DNA, 892 bp, Homo sapiens
ccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgaccttc

SEQ ID NO: 34030 - DNA, 3405 bp, Homo sapiens
gtgcgctgccgtaccggtcacgtggacgtttggtcacgtgactgcgtccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaagagtgctacctggagggtgaccagacgagcctgtaccacgcagccaaggggctgatgaccctgcaagctctgtatggaacgatcccccagatctttgggaaaggagaatgcgctcggcaagtggccaatatgatgatcaggatgaagagagagtttacaggaagccagaattcaatatttcctgtttttgataatctcttgttgcttgatcggaatgtggatttattaacacctcttgccactcagctgacatatgaaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaaaaccccacggacatatcgtatgtgtacagtgggtatgccccgctcagtgtgcggctggcccagctgctttcccggcctggctggcggagcatcgaggaggtcctccgcatcctcccagggccccactttgaggagcggcagccactgcccacaggactgcagaagaaacgtcaaccgggagaaaaccgagtgactctgatatttttccttgggggcgtaaccttcgctgaaattgctgccctgcgatttctctcccagttggaagatggaggtacagaatatgtcattgccaccactaaactaatgaatggaaccagttggatagaggctctgatggaaaaacctttctaggatgttcagaggagacttaacaagtgtactgcagaataaactacctctttgaagaaattgctgaaaggaagtaaaaccccatagaagaaacatgggaatacagaatatattctggggtcagcttcttaaattatactactgtttactgctttctccgtctcttttgtattccctttttttttttcctttgagacggagtcttgctctgtcacccagactagagtgcagtggcacggtctcacctcactgcaacctccacctcctaggttcaagcaattctcctgcctcagcctcctgagtagctgggactacaggcatgcaccaccacacccggctaatttttgtatttttagtagccatggtgtttcaccatgttggccaggctggtctcaaactcctgacctcaggtgatccacctgcctcggcctcccacagtgctgggattacaggcctgagccaccgtgcctggcccctaatctgctgaagaaagaagaatagaagaaaatcaacctgagtaaaagcagcactggttttgagttttctaagctcagggtcttcattagagacctctggaaatacattaaggatggtgggggtagataatccattcagccagacaaacggggccagctcttaaaataagaaagctgagactgaggaggtgaaactgaaaataaaaagagaaagttcatcctctaatccccagtgctgtatttcttcaaggcgcatcaggcctaggacagtggttaagtgttgggagctggagatcattttatcactgagttgagatttctttttcctgcagagtgtgggagattatatttagggtcatcagtcactgtcgcaactgatcactaaggcaagtttgcttccttctacttcttacaaagcaagaggtttaggggagcttcttgcccagaaacaaagtttatgctctatgtgatcagctacatctccttaggttccatacttatcaggggcttttgacatggaagaatgtgataattggggagcaaccttctgagaattcagcctttgaagtaattcaaagacagtttcttagcacacacgttaactccagacacagcagtggtgggtgcctccattgaggtttccgttttctcttctgtccatcaagggcccaacatccaactggtcccacagtgagcaggggcaactcttgcttcttcagcatctggccacttcgtttccatggtaactgccacgtgtacttttctagcagtctgtggccactccgtactcagctgaaaacactgtttcagccccctctctggtgacctcagccttctccaggtgtatctcttgatgatcttggagaccagcagccacagctgctgctactcctgcaggagactgtcaggctgtggtggggggcaggggtgttggaggagaagttgaaaatccgtgtgttctctgcccctctgctcctccatcttagcttctggaggagttaaggcaccaagggcaccaagtcaggttg

SEQ ID NO: 34031 - DNA, 2767 bp, Homo sapiens
gagatctaggaagtcgcttctttttctggtagaaggcggggttctcctcgtacgctgcggagtctctgcggggtgtagaccggaatcctgctgacgggcagagtggatcagggagggagggtcgagacacggtggctgcaggtctgagacaaggctgctccgaggtagtagctctcttgcctggaggtggccattcattcctggagtgctgctgaggagcgagggcccatctggggtctctggaagtcggtgcccaggcctgaaggatagccccccttgcgcttccctgggctgcggccggccttctcagaacgaagggcgtccttccaccccgcggcgcaggtgaccgctgccatggcttttccccatcggccggacgcccctgagctgcctgacttctccatgctgaagaggctggctcgagaccagctcatctatctgctggagcagcttcctggaaaaaaggatttattcattgaggcagatctcatgagccctttggatcgaattgccaatgtctccatcctgaagcaacacgaagtagacaagctatacaaggtggagaacaagccagccctcagctccaatgaacaattgtgcttcttggtcagaccccgcatcaagaatatgcgatacattgccagtcttgtcaatgctgacaaattggctggccgaactcgcaaatacaaagtgatcttcagccctcaaaagttctatgcgtgtgagatggtgcttgaggaagagggaatctatggagatgtgagctgtgatgaatgggccttctctttgctgcctcttgatgtggatctgctgagcatggaactaccagaatttttcagggattactttctggaaggagatcagcgttggatcaacactgtagctcaggccttacaccttctcagcactctctatggaccctttccaaactgctatggaattggcaggtgcgccaagatggcatatgaattgtggaggaacctggaggaggaggaggatggcgaaaccaagggccgaaggccagagattggacatatctttctcttggacagagatgtggactttgtgacagcactttgctcccaagtggtttatgagggcctagtagatgacaccttccgcatcaagtgtgggagtgtcgactttggcccagaagtcacatcctctgacaagagcctgaaggtgctactcaatgccgaggacaaggtgtttaatgagattcggaacgagcacttctccaatgtctttggcttcttgagccagaaggcccggaacttgcaggcccagtatgatcgccggagaggcatggacattaagcagatgaagaatttcgtgtcccaggagctcaagggcctgaaacaggagcaccgcctgctgagtctccatattggggcctgtgaatccatcatgaagaagaaaaccaagcaggatttccaggagctaatcaagactgagcatgcactgctagaggggttcaacatccgggagagcaccagctacattgaggaacacatagaccggcaggtgtcgcctatagaaagcctgcgcctcatgtgccttttgtccatcactgagaatggtttgatccccaaggattaccgatctctgaaaacacagtatctgcagagctatggccctgagcacctgctaaccttctccaatctgcgaagagctgggctcctaacggagcaggcccccggggacaccctcacagccgtggagagtaaagtgagcaagctggtgaccgacaaggctgcaggaaagattactgatgccttcagttctctggccaagaggagcaattttcgtgccatcagcaaaaagctgaatttgatcccacgtgtggacggcgagtatgatctgaaagtgccccgagacatggcttacgtcttcggtggtgcttatgtgcccctgagctgccgaatcattgagcaggtgctagagcggcgaagctggcagggccttgatgaggtggtacggctgctcaactgcagtgactttgcattcacagatatgactaaggaagacaaggcttccagtgagtccctgcgcctcatcttggtggtgttcttgggtggttgtacattctctgagatctcagccctccggttcctgggcagagagaaaggctacaggttcattttcctgacgacagcagtcacaaacagcgctcgccttatggaggccatgagtgaggtgaaagcctgatgtttttcccggccagtgttgacatcttccctgaacacattcctcagtgagatgcaggcatctggcacccagctgctataaccaagtgtccaccaactacctgctaagagccgggagcatggaacgtgttgggatttagagaacattatctgagaaaagagttcacttcctgctcccaggatatttctcttttctgtttatgaagtacaacccatgctgctaagatgcgagcaggaagaggcatcctttgctaaatcctgtttgaatgtcattgtaaataaagcctctgctctcagatgtaatacgttggtcgttctggacacgcacttccatctttattagtgaaagcccattggagcttgctacaggggcttcctgtgcttcttggcctggactttgtagtggctccaggcctggtctggttcttccctgtaaaaatcactctaccactctgtacctgagtttcctctaccataaaatgagggagatggctgaggtgaccagcaagcacgtttccagttctaaaatgttgtgattcattacatttttgagaaaatga

SEQ ID NO: 34032 - DNA, 1916 bp, Homo sapiens
ggtagaaggcggggttctcctcgtacgctgcggagtctctgcggggtgtagaccggaatcctgctgacgggcagagtggatcagggaggctggctcgagaccagctcatctatctgctggagcagcttcctggaaaaaaggatttattcattgaggcagatctcatgagccctttggatcgaattgccaatgtctccatcctgaagcaacacgaagtagacaagctatacaaggtggagaacaagccagccctcagctccaatgaacaattgtgcttcttggtcagaccccgcatcaagaatatgcgatacattgccagtcttgtcaatgctgacaaattggctggccgaactcgcaaatacaaagtgatcttcagccctcaaaagttctatgcgtgtgagatggtgcttgaggaagagggaatctatggagatgtgagctgtgatgaatgggccttctctttgctgcctcttgatgtggatctgctgagcatggaactaccagaatttttcagggattactttctggaaggagatcagcgttggatcaacactgtagctcaggccttacaccttctcagcactctctatggaccctttccaaactgctatggaattggcaggtgcgccaagatggcatatgaattgtggaggaacctggaggaggaggaggatggcgaaaccaagggccgaaggccagagattggacatatctttctcttggacagagatgtggactttgtgacagcactttgctcccaagtggtttatgagggcctagtagatgacaccttccgcatcaagtgtgggagtgtcgactttggcccagaagtcacatcctctgacaagagcctgaaggtgctactcaatgccgaggacaaggtgtttaatgagattcggaacgagcacttctccaatgtctttggcttcttgagccagaaggcccggaacttgcaggcccagtatgatcgccggagaggcatggacattaagcagatgaagaatttcgtgtcccaggagctcaagggcctgaaacaggagcaccgcctgctgagtctccatattggggcctgtgaatccatcatgaagaagaaaaccaagcaggatttccaggagctaatcaagactgagcatgcactgctagaggggttcaacatccgggagagcaccagctacattgaggaacacatagaccggcaggtgtcgcctatagaaagcctgcgcctcatgtgccttttgtccatcactgagaatggtttgatccccaaggattaccgatctctgaaaacacagtatctgcagagctatggccctgagcacctgctaaccttctccaatctgcgaagagctgggctcctaacggagcaggcccccggggacaccctcacagccgtggagagtaaagtgagcaagctggtgaccgacaaggctgcaggaaagattactgatgccttcagttctctggccaagaggagcaattttcgtgccatcagcaaaaagctgaatttgatcccacgtgtggacggcgagtatgatctgaaagtgccccgagacatggcttacgtcttcggtggtgcttatgtgcccctgagctgccgaatcattgagcaggtgctagagcggcgaagctggcagggccttgatgaggtggtacggctgctcaactgcagtgactttgcattcacagatatgactaaggaagacaaggcttccagtgagtccctgcgcctcatcttggtggtgttcttgggtggttgtacattctctgagatctcagccctccggttcctgggcagagagaaaggctacaggttcattttcctgacgacagcagtcacaaacagcgctcgccttatggaggccatgagtgaggtgaaagcctgatgtttttcccggccagtgttgacatcttccctg

SEQ ID NO: 34033 - DNA, 4943 bp, Homo sapiens
gaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcacgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaacacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagtactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccaccgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagaattaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtgctttgtgtgtctgcta

SEQ ID NO: 34034 - DNA, 2698 bp, Homo sapiens
acgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcacgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcgatagtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgt

SEQ ID NO: 34035 - DNA, 4315 bp, Homo sapiens
ggagggccggggctgggtggcagcggccatggaccgcttcgtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgtttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaacaatgggacatgtcatgaactggtttctttttttaaaaaattcttgatgtgaattccactgttacctgaccatgtatattcagatgaatgtactctttcttgttccttgttaccagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaa

SEQ ID NO: 34036 - DNA, 911 bp, Homo sapiens
gcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttaccagctagaaatcaggtggcaccatccgcactgcctggaaatctccttagctagatcatccaattcactagggttttccatttcttcctccatatcctccacaagaagcaaacaggagtatcacttctttatctgttgctga

SEQ ID NO: 34037 - DNA, 4906 bp, Homo sapiens
agctggcgccatcgcgcaccctctcaggttcatcgtccccgccccctttctacttccctaacccgcccctccccccgtaaggctgcagcggatgcaagatctacttgtgtcgctgagctcgcgctcctcctcctcctcctcgccatagagacagcactcggcggcggtggcggtggcggtggcggtagcggcggcggcagcgggtgccccatagacacctctcgcccagcgaagggaaaggcgagcaggagctgcgccgcaccgtgctgcgccgtcgcttttcgcacgtcctgacgggggcgctagatgatgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttctttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcagtgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctatatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcata

SEQ ID NO: 34038 - DNA, 1307 bp, Homo sapiens
cccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatattt

SEQ ID NO: 34039 - DNA, 3021 bp, Homo sapiens
gggctcacaggctgcgggaacttccttcccactgcctgttttccttggatcgcggtatctctcttcctggaggaaaaaggctcttatgacctcatggcgcgctctcccgagccgcagtgacgtcattaatgcgctcacgcgtcacagcccaatcatagggcccttcccctccctttagaagtcccgactgtccctgacacattccactccaagcgagccgcgacacttacgtcacgtccgcccgcccgcgcggtgatgacgtcacgacccagggctggcgtcacgtgtcccccccgcggggggcggcccttgagggcggcgcttccggtcggcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccccagtcccatttagaatcgtggtccttctgttgcagctttatttaatgagcatggttcatgatacttattttattttcgaaagacagtcctatgtgtctcacccaccggccactgcagccctggtgagggcgggtgggcgccggccggcctggaagagcgccgtggctgggccaccacctgtggctgcgttgttgctcactgaatctgttggggagaggtcaccatagtcaccgcctgacctggctgctgctcttgcttcagagccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccaatatttttactacgtgtgtgattttcctgttttatattgaaaaaacttttttgacactcccaagaccattcagggaaattttataaaaaatgcagatactgtcttgagcagatcgaaatgccgatgaagtggatgcaatttccttttgtgcaagcagtgcacggtgcccccccctcgggtgtccgtgctgtgccttagcttccccaggtgccgggactcacacctgctaggggctgggcaaggccccggctctgctttctctgaagggcttgtccaagttcattgccctgttacaggtggtcaagacgtccggccgccttgacccaggctacccttagccaatatcctctgcccctgggtggctggtggctgggcctcagggtgggcaacgttaggggtttggcgaaagcccgccccatgggattgagggacggggctgcactccaaccgtctgcacctgctcttcccccacccctgtgggacctcatcttcacgtgccatgtgtgctgaaggcccagggcccagcagggggcagtggcacctgttgacggaaaaggccgaggtgcttaccagtggaccttctggcccgcccctcccctgtcacttgtcgggcatccagggccccgacctgtgcctagccgccagggtgacagaaggcagaactgaagcggggtctgggccacgggccaggccactgccttttgtcctcagtgaccgtacattcctgctctcggacttgaactctactgtaactgttttcttaaaggaaatgaagctgtacaggacgattcactgccatgccagtcaggcgggcttgccatgttctgtgaatctcgagtgagcggtgccacccgcccccatacctccgccaccggccgctgtcggggatgccacagcctgccacggtcgcagccagacgtgagcttggcattgaagttgcaaagcggcccctggccgggctcgccgtcgctgtccagggccgtgtccggtgctgtggctgtaaagctgtaggaccctttttaataaatagagaattatt

SEQ ID NO: 34040 - DNA, 2865 bp, Homo sapiens
gtggcccgggcggccgcgagcgtgtgtgtgtggcacgatgtcgtggtaactcagaggcgcgcgaggcggggcggccaacggggtcgcggggcgagcacgcgcgccactggggcgccggacgttgcaagggggtcacatccggtagggggcgggcctggcggaccccggaagtgtgggcgcggctgcggtttaacccgcggtggcggcggcgacggcggccctggcagggaaggatggagacgctgaaggataagaccctgcaggagctggaggagttgcagaatgactcggaggcgattgaccagctggccctggagtcccctgaggtccaggacctacagctggaacgggagatggcactggccaccaaccggagcctggcagagcggaacttggagttccagggtcccctggagatcagccgctcaaacctctcggatagataccaggagctccggaagctcgtggagcggtgccaggagcagaaggcaaagctggagaaattttcttcagcactgcagccagggaccttgttagaccttctgcaggtggaaggcatgaagatcgaagaagagtccgaggccatggctgagaagttcctggagggcgaggtgcccctggaaacgttcctggagaatttttcctccatgaggatgctgtcccacctgcgccgggttcgcgtggaaaagctccaggaagtggtgaggaagcccagggcttcccaggagctggccggcgatgcccctccaccccgtccaccacccccggtgcgcccagtcccccagggaacaccccctgtggttgaagagcagccgcagccaccattagccatgcctccctaccctttgccctacagcccatcccccagcctgcctgtgggccccactgcccatggagccctgccaccggcccctttcccagtagtgtcccagccctccttctacagcgggcctctgggccccacttacccggcagcccagcttggacccaggggtgctgcgggttactcctggtccccacagaggagcatgccaccccggccgggctatcctgggaccccaatgggtgcctctgggcctgggtaccccttgcggggaggcagggcccccagtcctggttatcctcaacagtccccataccccgcaacaggaggaaaacctccctacccaatacagcctcagctccccagctttccaggccagccccagccctcagtgcccctgcagcccccttatccccccgggcccgcccctccctatgggttcccaccaccgccggggcctgcctggcctgggtattagacacactcctggccctcggcccctccctagtcccacccacgctcaacctttggcccagccatcgccgagattcgagggtcaactggaagtggcgttggtgctccctgtggacttgcgtcggcacccagaggccttggagggacaaggcactgggcggtgtgactggtcatggcacttgctggccttctggccagaggtcctcctggaagcccctcctttcagtgcctggctgcagcggtgctagccaggctggagtccagcacctctcgccggtgtctgtgtgagtgagcgcatgtgcgcatttatgagcatctacttgcggctgcactcagggccatttgaacccagtgcagagttatctctatgaggaggccccgggtctccagccccctccatctcccctggggtttggcatatttgacatggagccccatgccaagggatgcagctgttggtgtctgtccagtccattcaaggctagcctgcccatgcactgtggcaggggttggattggagggagagaacagagttgggaaaaacaacaggtttgagtcctataaagccataatttaactccagtagctgatgtcagacaagcttgtcctatgtcctatttgagtggcagcagcgccagcccagcaagaaggctgggggttgtcaaggttgtccccagaccttgcttgcagtggttggagaacccagggggctgccttgggccctctggccagagggaagcgggcagctctagccctggagattgtggtcacattggggcttgtttaggattggagggccaggtcacctccccagccaccctcccttctctcctctggggtccccactttagggcgactttgcccgaggcccacgcatccatccactcctttagtgccttgaatctcattcacaagcagccccctcccttcccctccccttctcactctgttgatgtaatcctcccacccccagtgtccatcctaagacaggcatcaaaagaggccctaactttacttcccaaatggtgctttttaaaaaacaccatcactacattaggggcaattttttcacacctccctgtcttcagaatgtaaagggtggggattatgtctctgtttaatatgcagccccctgcactgtggggtttggggcatgttcagtaataagaatgaatacaatagacaaagggggtgtgatgagtgttaacttggttgttccagaggtaaaccaggtctcagggaagagcctggagctgctattgcttaggaagttgtacgtgccttgaaatgtccactacctgaggacgcagcatctggtgggcccggggctgctggggccaaggagggaccttgaccttctggtgcctgcccctccccggcctatgtgccatccgcgtgacgctaggtcagcgctgccggttctttaccaaatgtgcttgcttctcctaagttatttataaagagaaatcactaatggactctactggtttgagtgcttctgagctggatgaccgaccgcctgtatgtttgtgtaattaattgccataataaactttgatgagtcacat

SEQ ID NO: 34041 - DNA, 506 bp, Homo sapiens
ccccaccactcaccgccaccctcctttctgcgtctctgcaggccctcgtcccatatggaaggatggagacgctgaaggataagaccctgcaggagctggaggagttgcagaatgactcggaggcgattgaccagctggccctggagtcccctgaggtccaggacctacagctggaacgggagatggcactggccaccaaccggagcctggcagagcggaacttggagttccagggtcccctggagatcagccgctcaaacctctcggatagataccaggagctccggaagctcgtggagcggtgccaggagcagaaggcaaagctggagaaattttcttcagcactgcagccagggaccttgttagaccttctgcaggtggaaggcatgaagatcgaagaagagtccgaggccatggctgagaagttcctggagggcgaggtgcccctggaaacgttcctggagaatttttcctccatgaggatgctgtcccacctgcgccgggtt

SEQ ID NO: 34042 - DNA, 1230 bp, Homo sapiens
actggggcgccggacgttgcaagggggtcacatccggtagggggcgggcctggcggaccccggaagtgtgggcgcggctgcggtttaacccgcggtggcggcggcgacggcggccctggcagggaaggatggagacgctgaaggataagaccctgcaggagctggaggagttgcagaatgactcggaggcgattgaccagctggccctggagtcccctgaggtccaggacctacagctggaacgggagatggcactggccaccaaccggagcctggcagagcggaacttggagttccagggtcccctggagatcagccgctcaaacctctcggatagataccaggagctccggaagctcgtggagcggtgccaggagcagaaggcaaagctggagaaattttcttcagcactgcagccagggaccttgttagaccttctgcaggtggaaggcatgaagatcgaagaagagtccgaggccatggctgagaagttcctggagggcgaggtgcccctggaaacgttcctggagaatttttcctccatgaggatgctgtcccacctgcgccgggttcgcgtggaaaagctccaggaagtggtgaggaagcccagggcttcccaggagctggccggcgatgcccctccaccccgtccaccacccccggtgcgcccagtcccccagggaacaccccctgtggttgaagagcagccgcagccaccattagccatgcctccctaccctttgccctacagcccatcccccagcctgcctgtgggccccactgcccatggagccctgccaccggcccctttcccagtagtgtcccagccctccttctacagcgggcctctgggccccacttacccggcagcccagcttggacccaggggtgctgcgggttactcctggtccccacagaggagcatgccaccccggccgggctatcctgggaccccaatgggtgcctctgggcctgggtaccccttgcggggaggcagggcccccagtcctggttatcctcaacagtccccataccccgcaacaggaggaaaacctccctacccaatacagcctcagctccccttctcactctgttgatgtaatcctcccacccccagtgtccatcctaagacaggcatcaaaagaggccctaactttacttcccaaatggtgctttttaaaaaacaccatcactacattaggggcaattttttcacacctccctgtcttc

SEQ ID NO: 34043 - DNA, 1624 bp, Homo sapiens
ggcggcggagcggtgcgtgcggccggagccggagcggatcctggagccggagcggagcggagcggagcggagccggggcggagcgggccgagcgggccgagccagcagccgagctgggggcgcgggcgggcggcatgtaccgggcccgggcggcgcgggcggggccggagcccggcagcccggggcgctttgggatcctcagcaccgggcagctccgggacctgcttcaggatgagcccaagctggaccggatcgtgcggctcagcaggaagttccagggcctgcagctggagcgtgaggcctgcctggcctccaactacgcgctggccaaggagaacctggccctgcggccccgcctggagatgggccgggctgccctggccatcaaataccaggagcttcgtgaggtggccgagaactgcgcggacaagctgcagcgactggaggaaagcatgcatcgctggagtccccactgcgcgctgggctggctgcaggctgagctagaagaggcggagcaggaggcagaggagcagatggagcagctgctgctcggggagcaaagcctggaggccttcctgcctgccttccagcgtggccgcgccctggcccacctgaggcggacgcaggcagagaagctgcaggagctgctgcggcgtcgggagcgttctgcccagccggcccccacctcggctgctgatccccccaaatccttcccggctgcagctgtcctgcccactggggccgcccgggggccaccagcagtgccccggagcctgccccccttggactcccgcccagtgcccccactgaagggctcccccgggtgccccctcggcccggcccccctgctgagccctcggccctcgcagccagagcccccccaccggtaggatccacggtgcggccccccagttggggggcctagacaaacttgatgcgtggctcctcctcctcccccactgcctgggtggggggaggggcaggcccctccccctggcctcaggcaggccctggccctggaggctgagctggggaggagggtcccctggaagaggcccgagagggggctgggggtgggtgggcagggctttatgcctctggcgctgaagacaccctgccttttttgtttccgtgccccggggcctctagggtgatggaccagccccgttaaagaacttgactcaactacaggggcctgggaagatgcctgggtcccctaggggccttgccaaggggacctgtcgcaccccaccactccactgggctcgcacaacgccaaggccgccaggagtgttttacatcatgtcctgagcctacctttcccccaaattctggggcccacagcctaggagccaggtgatcaggcctcggctgtggggccagggacaccatggccctggggctactacgtgtccacacatgctccagaccctggggcaaggtaggccaggggcttctgacctgtgcaggtgagagtgggccatacccaggaaagaccattctgtatttttctgtccctgtctccttagaatggaagctttttgagggcaggtccttgtctttgtacgttctgtccccagccccgcctcttaggggccgtcaataaatgtgatgatgaggatga

SEQ ID NO: 34044 - DNA, 4844 bp, Homo sapiens
agcaggaagtccggggttgacgatggctgtgttgttgaagggcctgtagccggggggttcctggccggatcccggtctacccttagcccagactcgttccggaccccagcccggcccggaacactctgggcgagacggcggtggcaactctccccttgccgccatgcacgacgctttcgagccagtgccgatcctagaaaagctgcctctgcaaatcgactgtctggctgcctgggaggaatggcttcttgtgggaaccaaacaaggacatcttcttctctataggattcggaaggacgttggttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttgagcccagcatcctggggatccagcggatggacagcttggctctcccagagaggtgaaggagcacctggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagcagcagggaagctctgggccacctccctggatagcaggaacttgacctgccatgtgtgccctgccttcctggccagctgtgcttgttatcttccattctcacaaactgtctttgaagcaatagaataaagaatgtgtgttttctttcctggtatacatacatgatcccatgctcccaagctccattcttccttccctcaactctctgccctccacagagctatggagaaggctggagatgaaagctttgtagtgaggactgataaagatctcatcactgctccttataataaacctaataaagcaagaaaccaagccta

SEQ ID NO: 34045 - DNA, 2661 bp, Homo sapiens
atgcacgacgctttcgagccagtgccgatcctagaaaagctgcctctgcaaatcgactgtctggctgcctgggaggaatggcttcttgtgggaaccaaacaaggacatcttcttctctataggattcggaaggacgttgtgccagcagatgtagcatcacctgaaagcggcagttgcaacagatttgaagtgacactagagaaatccaataagaacttctccaaaaagattcagcagatccatgtggtttcccagtttaagattctggtcagcttgttagaaaataacatttatgtccatgacctattgacatttcaacaaatcactacggtttcaaaggcaaagggagcatcactgtttacttgtgacctccagcacacagagaccggtgaggaggtgttacggatgtgtgtggcagtaaaaaagaagctgcagctctatttctggaaggacagggaatttcatgaattgcagggggactttagtgtgccagatgtgcccaagtccatggcgtggtgtgaaaattctatctgtgtgggtttcaagagagactactacctaataagggtggatggaaaggggtccatcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttttgatgagtccatgcaggtctttgctaaacttggcacagatcccacccatgtgatgggcctgtaccctgacctgctgcccacagactacagaaagcagttgcagtatcccaacccattgcctgtgctctccggggctgaattggagaaggctcacttagctctgattgactacctgacacagaaacgaagtcaattggtaaagaagctgaatgactctgatcaccagtcaagcacctcaccgctcatggaaggcactcccaccatcaaatccaagaagaagctgctacaaatcatcgacaccaccctgctcaagtgctatctccatacaaatgtggccctggtggcccccttgctacgcctggagaacaatcactgccacatcgaggagagcgagcacgtgctaaagaaggctcacaagtacagtgagcttatcatcctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctactcagtgtgggtgctgagagacttcccagaagatggcctgaagatatttactgaagatctcccggaagtggagtctctgccacgtgatcgagtcctcggcttcttaatagagaattttaagggtctggctattccttatctggaacacatcatccatgtttgggaggagacaggctctcggttccacaactgcctgatccagctatactgtgagaaggtgcaaggtctgatgaaggagtatctcctgtccttccctgcaggcaaaaccccagtcccagctggagaggaagagggtgagctgggagaataccggcaaaagctcctcatgttcttggagatttccagctactatgatccaggccggctcatctgtgattttccctttgatggcctcttagaagaacgagctctcctgttggggcgcatggggaaacatgaacaagctcttttcatttatgtccacatcttgaaggatacaaggatggctgaggagtactgccacaaacactatgaccgaaacaaagatggcaacaaagatgtgtatctgtccctgcttcggatgtacctgtcgccccccagcattcactgcctggggccaatcaagctggaactactggagccaaaagccaacctccaggccgctctgcaggtcctcgagctacaccacagcaaactggacaccaccaaggccctcaaccttctgccagcaaacactcagatcaatgacatacgcatcttcctggaaaaggtcttggaagaaaatgcacaaaagaaacggttcaatcaagtgctcaagaaccttctccatgcagaattcctgagggtccaggaagagcggattttacaccagcaggtgaagtgcatcatcacagaggagaaggtgtgcatggtgtgtaagaagaagattgggaacagtgcatttgcaagataccccaatggagtggtcgtccattacttctgttccaaagaggtaaacccagctgacacttga

SEQ ID NO: 34046 - DNA, 2175 bp, Homo sapiens
cctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagctgcttcacttgggcaatggtgaaggtgggaggttgattggggcaaatccaggcactccccatgtcaacagccagacagggctccagggcttgtcccagtcaatacagagttccctctgctgtctggccgtctgccagggagccagaaggaagggccttgcagccacagagacactccactgccctggggcacacagtggacactgctcttcctacttcctcctctcctggatgctcatcagctccttctgcctcccccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccaccctcctaggttcacatccagggctgtgtcttccttgggggaggagatggtgtcgtttagatcagggtaaggcagtcaggcgggtgttcaccactgccttttcttcctctgagcgtgagaacactgaacccagccactgcccctgggtccctgtcctggaaatggtctaataaatccttttcccttcttgagct

SEQ ID NO: 34047 - DNA, 3321 bp, Homo sapiens
gcggaagtttggtggggagggtcggagctctggtggagagagtgttgtctaaaacaagttccggaagggaggctgcccttcgcggtccgagaaccaccggcctccccagtttgagggctgttaccccgtgcgcgcttcgacgttgctgctgttggctctcctcgcccctcgttcccttgggaaccgcctgggaactccgccatgtcatccacttcgcccaacctccagaaagcgatagatctggctagcaaagcagcgcaagaagacaaggctgggaactacgaagaagcccttcagctctatcagcatgctgtgcagtattttcttcatgtcgttaaatatgaagcacagggtgataaagccaagcaaagtatcagggcaaagtgtacagaatatcttgatagagcagaaaaactaaaggagtacctgaaaaataaagagaaaaaagcacagaagccagtgaaagaaggacagccgagtccagcagatgagaaggggaatgacagtgatggggaaggagaatctgatgatcctgaaaaaaagaaactacagaatcaacttcaaggtgccattgttatagaacgaccaaatgtgaaatggagtgacgttgctggacttgaaggagccaaagaagcactgaaagaggctgtgatactgcctattaaatttcctcatctttttacaggcaagagaacaccttggaggggaatcctattatttgggccgcctggaacaggaaagtcctacttagccaaagctgtagcaacagaagccaacaactcaacatttttttcaatatcttcctctgatcttgtttctaagtggctaggtgaaagtgaaaaactggttaagaatttattccaacttgccagagagaacaagccctccattatcttcattgatgaaattgattctctctgtggttcaagaagtgaaaatgaaagtgaagccgcacgtagaattaagacggagttcctagtgcaaatgcaaggggttggtgtagacaatgatggaattttggttctgggagctacaaatataccctgggttctggattctgccattaggcgaagatttgagaaacgaatttatattcccttgccggaaccccatgcccgagcagcaatgtttaaactgcacctagggaccactcagaacagtctcacggaagcagactttcgggaacttgggaggaaaacagatggttattcaggggcagatataagtatcattgtacgtgatgcccttatgcagcctgttaggaaagtacagtcagctactcattttaaaaaggttcgcggaccttcccgagctgatcctaaccatcttgtagatgatctgctaacaccttgctctccaggtgaccctggtgccattgaaatgacatggatggatgtccctggagataaacttttggagccagttgtttccatgtcggatatgttgcggtcactatctaacacaaaacctacagtcaatgaacatgacttgttgaaattaaagaagtttacagaagattttggtcaagaaggctaagccaaagacaaggaagatgcttaccatatgtattctttctttcatagatatttttgtctatttggatcgcattaattgtttccagtaaaactcttttaccacagggaaatacacatctcacttcagagttccattaggttttatattgtacttttcctccattacttattaaatactcctattaacaaaaggtacaaaataacaggttatgaggaaatgagcgatatatgaacggcataaaaacagaaattacccagtaaaaaggatgtcagaaattgacatacaaatatttacaatttttatgaatggtggtctttgcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacgatgctattttaatattttcaaataaataatctgaggatgtgtttcatactttagcatcaacgctgagttgtgccttgtagaattgcattgtctatacatgcaaaagactattaagttaggatgaactagattccctaattacagtgaaattctatcttgcaaatgctatagaataacttgcattttaaagtgtatttgcacattttacatatgctatgtggttgcctttgggttttctgtacagattgtttttgttattaaatggaaaaggcctgaattatgctcttatgtgaagtaaattgatataacctattgactgtattctgtgtattattctttattttgggaccttctgtgtaaaagaaaatattacctaaattggttagatacaaagaaatcattaaaattattaatgtatatatgaaaa

SEQ ID NO: 34048 - DNA, 769 bp, Homo sapiens
gactctcccgtggcgccatggcggaagcagaggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgagtaagaaacctgaggcatggagagtagccaagaaaatgaaaagctatcttaataattgaaggactgcattgggaatgggtcttgaaaatatcatttgcctgttggccaaagggtgtgaagatttttgacatcatctcaaagcaaagaatcaccaatgtgccccgggatgatataagtcttc

SEQ ID NO: 34049 - DNA, 5903 bp, Homo sapiens
aagtgtgtggtttcctcttatttccgggtctgtcaggtgactctcccgtggcgccatggcggaagcagaggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattagccaggcgtggtggtacatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgatttattaaaggatattcaatcctttttacttttcatcaacctataagggcttaaatatggcaaaataatccaagtgttagtcaattatttttcatgtgtgactagcccaatttaaaatataggtaaaaaggaaacccattcccctcgttttggggaagaacatagttgcaaagtacacacttcataagctattctttttttttttttttttttttttttttttgagatggagtctcgttctgttgccttggctggagtgcagtgacatgatcttggctcactgcaacctccgcctcccaggttcaagtgattctcccgtctcagcttccggagtaggtgggagtacaggcacgcaccaccatgcccagctaattttttgtactttggtagagatgaggtttcaccatgttgcccaagctggtctcgaactcctgagctcaggaatccgcccacctcggccttccgaagtgttaggattacaggcgtaagtcaccatgcccagccaagaaagctattcttgaagtgtaaaacagccaggtgcaaaattattttggagtactttagtttgcttttgtttttagccaaagggatttcatactggtttaattatgttcatccttgagaatttttgagaagtttccaacagatttgtagttcattttgctgttgttacaatgtaaagctatatatagttgacccttgaacaacacaggttggaactgcaaggatccacttatacatggattttcttctgcctctgccacccttgagacggcaagaccaggccctccccttcctcctccttctcagcctactcagtatgaagacgacagagatgaaacacttatgatgatccacttctacttaatgagtagtaaatatattttcttttccttatgattttcttactattttctttagcttgctttattataagaatatagcatataatataaataaaatataaaatatgtgttaatggtc

SEQ ID NO: 34050 - DNA, 3181 bp, Homo sapiens
atggcggaagcagaggagcaggaaactgggtcccttgaagaatctacagatgagtctgaggaagaagagagcgaagaggaacccaagctgaagtatgaaaggctttccaatggggtaactgaaatacttcagaaggatgcagctagctgcatgacagtccatgacaagtttttggcattgggcacacattatggcaaggtttatttacttgatgtccaggggaacatcactcagaagtttgatgtagtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtgtgctcagtgaaggaacggcatgccagtgaaatgagggatttgccaagtcgatatgttgaaatagtgtctcagtttgaaactgaattctacatcagtggacttgcacctctctgtgatcagcttgttgtactttcgtatgtaaaggagatttcagaaaaaacggaaagagaatactgtgccaggcctagactggacatcatccagccactttctgagacttgtgaagagatctcttctgatgctttgacagtcagaggctttcaggagaatgaatgtagagattatcatttagaatactctgaaggggaatcacttttttacatcgtgagtccgagagatgttgtagtggccaaggaacgagaccaagatgatcacattgactggctccttgaaaagaagaaatatgaagaagcattgatggcagctgaaattagccaaaaaaatattaaaagacataagattctggatattggcttggcatatataaatcacctggtggagagaggagactatgacatagcagcacgcaaatgccagaaaattcttgggaaaaatgcagcactctgggaatatgaagtttataaatttaaagaaattggacagcttaaggctattagtccttatttgccaagaggtgatccagttctgaaaccactcatctatgaaatgatcttacatgaatttttggagagtgattatgagggttttgccacattgatccgagaatggcctggagatctgtataataattcagtcatagttcaagcagttcgggatcatttgaagaaagatagtcagaacaagactttacttaaaaccctggcagaattgtacacctatgacaagaactatggcaatgctctggaaatatacttaacattaagacataaagacgtttttcagttgatccacaagcataatcttttcagttctatcaaggataaaattgttttattaatggattttgattcagagaaagctgttgacatgcttttggacaatgaagataaaatttcaattaaaaaggtagtggaagaattggaagacagaccagagctacagcatgtgtatttgcataagcttttcaagagagaccaccataaggggcagcgttaccatgaaaaacagatcagtctttatgctgaatatgatcgaccaaacttacttccctttctccgagacagtacccattgcccacttgaaaaggctcttgagatctgtcaacagagaaactttgtagaagagacagtttatcttctgagccgaatgggtaatagccgaagtgccctgaagatgattatggaggaattacatgatgttgataaagcaatcgaatttgccaaggagcaagatgatggagagctgtgggaagatttgattttatattccattgacaaaccaccatttattactggcttgttaaacaacattggcacacatgttgacccaattctactgattcaccgtattaaggaaggaatggagatccccaatttgagagattccttggttaaaattctgcaagactacaatttgcaaattctgcttcgtgaaggctgcaagaagattctcgtagctgactctttgtccttactgaagaaaatgcaccgaactcaaatgaaaggtgttcttgttgatgaggagaacatctgtgagtcgtgcctttcccctattcttccatcagatgcagctaagcccttcagcgtggtggtcttccattgccggcacatgttccacaaggagtgcctgcccatgcccagcatgaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcatt

SEQ ID NO: 34051 - DNA, 2224 bp, Homo sapiens
atgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcagactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagagatggggtttcactatgttcccctgcctggtttcgaactcctgggctcaagcgatccacccgcctcagcctcccaaagtgctgggattacagctttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaa

SEQ ID NO: 34052 - DNA, 2790 bp, Homo sapiens
actgtttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaatagcgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaagga

SEQ ID NO: 34053 - DNA, 977 bp, Homo sapiens
gggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgc

SEQ ID NO: 34054 - DNA, 1714 bp, Homo sapiens
agccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagaattgcctcttgtctctgataaaggcaagcaactttttcatttggtgaggaaatggagctatatgatcatgcattccagaatcagtcaattcaaaaaggaagtacttttcatgtttatacaaatgtagtagaatcttgttgctacagcttattttttgtttctgtgaagcagcagtcctttttcattggccttttttcctgcagtaaatgctcataagaactgtaccatttacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaag

SEQ ID NO: 34055 - DNA, 1742 bp, Homo sapiens
aatttagccagaaaagggggcgggaagggctgtagggtacttgtcaattcgccgccatgaacgtggtttttgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttgg

SEQ ID NO: 34056 - DNA, 1347 bp, Homo sapiens
aggggctgcaggtggcggcgcagtctcggtaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggctctttgtgtttttccttgtcttttgtcctcagacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatccc

SEQ ID NO: 34057 - DNA, 1527 bp, Homo sapiens
gtggccacccgcaggtagtgatgtcgagcgtcgagctcccaaaaccgagctggtgaggggctgcaggtggcggcgcagtctcggtaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatcccttttgtctggtgtccagtctagggttgggagcaagaagtatttgaatacctgcatatatttgggtctttattcgatagcatttattatgagctgtcctttctaaattgtattcattcctccaactaaattataaacatctgaaaattgcacaccaaaa

SEQ ID NO: 34058 - DNA, 2172 bp, Homo sapiens
attcttcctcttgccacacccacagggcccgcactaagagcctaactgaaatcccgcgaggatcaaccgagctcgccgaaaggagggaggaacgtatcccttctggaggctgtctcagggggcagagggaccggaccggaagtgacgtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattcc

SEQ ID NO: 34059 - DNA, 1332 bp, Homo sapiens
gtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaatatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttcc

SEQ ID NO: 34060 - DNA, 1406 bp, Homo sapiens
gtgagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagact

SEQ ID NO: 34061 - DNA, 1430 bp, Homo sapiens
gagcgggttccggttgtctggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttctta

SEQ ID NO: 34062 - DNA, 1358 bp, Homo sapiens
gatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgc

SEQ ID NO: 34063 - DNA, 3913 bp, Homo sapiens
aagaatatgtgcttatggtaaaggcaggcggcaggtacggaggctgtgggaagtcggggtccctccgcccccacaggcagccctgtgctggcctggtgtatacgtttctgtgcagacgtacaccaccctgtgtgagcacagatgtatttttacacatggctctggacagctgtctgactctgtcagcagcaggccttggaggggctcaggcccgtgtgggggtggggggacatccagaggtctttgagtccagccctctgcctccaggccacgcccactcagtgtcgtcagagccccctgtgcctgaggcgtgcgcggctcggagccctgccctcggagtcctgcggtgccttcctcgagtctggcctgctttccatcctgctaagtacttggggcatttccctctttgggtaaggtgtggtcttccctgtcctggcattagacacaaggcagtgggccttcctgccattctaagtgtagcttaagacaatcagtgcaaagcaaccctttgtgggtgtccagcccttgcctcgggaggccagaaaggtggcctggggggagagcgtctaagctggctgtggaaagacccatgttgggatccattccacagaggtcgtcaggggtctctgcctggcctggaggtcccagagaggaccctcctcccctcaggaaggcccatctggaagggtagcagaggactgctcacaggaagagcatgcgaagtgctctttctggggatgcctgtagttggtgatgtgggaactgggttttgagggatgcctaggagttcatccatcagaggggaaatgaggaagccatgcaggatcaatggataaagtgtgctcaggtgagggttggctggtgggccgctgcagggcgggggcctgtccagtgctcccccacttacttgctgcctcccgactgctgtaattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttc

SEQ ID NO: 34064 - DNA, 2710 bp, Homo sapiens
ggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccgaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 34065 - DNA, 1564 bp, Homo sapiens
ctgccacggagccccagcggctacacactccactcactcacacctctcagggccccgcacgttcccacagccctcagggtgtacgtgctgtaggtgtggctgtgccccagagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaag

SEQ ID NO: 34066 - DNA, 3916 bp, Homo sapiens
ctttgggtaaggtgtggtcttccctgtcctggcattagacacaaggcagtgggccttcctgccattctaagtgtagcttaagacaatcagtgcaaagcaaccctttgtgggtgtccagcccttgcctcgggaggccagaaaggtggcctggggggagagcgtctaagctggctgtggaaagacccatgttgggatccattccacagaggtcgtcaggggtctctgcctggcctggaggtcccagagaggaccctcctcccctcaggaaggcccatctggaagggtagcagaggactgctcacaggaagagcatgcgaagtgctctttctggggatgcctgtagttggtgatgtgggaactgggttttgagggatgcctaggagttcatccatcagaggggaaatgaggaagccatgcaggatcaatggataaagtgtgctcaggtgagggttggctggtgggccgctgcagggcgggggcctgtccagtgctcccccacttacttgctgcctcccgactgctgtaattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcaggttagggaggctgggaaggccttttggggatgggggtgatttgtccaacggctgggggaggtgggaatggggaggtgagcaaggcagcagctctcagggcctggctgttgcgggtggtggtggcaggggctggaggctctaagcctagaataaggagaggcccaggtccagggaactgtgttcaattacatggatttgacacttggcagccctgagtgttttggggagagggaaggcaggcgggcagatgggggtcagagagcttagagggatggcagcccacctgggaaggcaggtgcgggtggagcccccaggcacgtgcagtgggtctctggctcacccagggcgaggagctgcccttagccaggcgtggcctcacattcagcttcctttgcttctcccagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 34067 - DNA, 1595 bp, Homo sapiens
agtcctgcggtgccttcctcgagtctggcctgctttccatcctgctaagtacttggggcatttccctctttggaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctga

SEQ ID NO: 34068 - DNA, 3066 bp, Homo sapiens
atggataaagtgtgctcaggtgagggttggctggtgggccgctgcagggcgggggcctgtccagtgctcccccacttacttgctgcctcccgactgctgtaattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattct

SEQ ID NO: 34069 - DNA, 553 bp, Homo sapiens
gcgcccggacgcggcggcccgtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagac

SEQ ID NO: 34070 - DNA, 4370 bp, Homo sapiens
taatgacgggaggaagaaaggcacaagcgctgagaaactgcaaaggctgtgggattggggttaccagagggtgcagtgacaatggggtaggagtggggtgctagtcagaaagttcagagtaggggtggttggaggcagcgttgagaaggagcaagaagtgtcagggtggtgatggcgtcttagaagatctccaggttttgggagaagatgggtgtatgggttaccacaataggactagactaatacaagggttcagtctattgtgccacgttcttccaggaggataaactccggagccaatgaactggagccaagtgggagagtccgcctctaagggattaaagggtctcctttcactaatcgatctcgccctattcctttcgttgattggctgagaattccaatccgtcgaggaagcgtagcgttgcggccaattgacgtggcgttactaggcgtgtcgcatcactgaggcgggagccaggccgcaagcgaatttcctgattggctgtgatctgcgggttgctggggagaggcgcggagaggcgggcgagagtccgcagggcaggcgctgattggctgaggtgggagcagcttcccttccgatgattcggctcttctcggctcagtctcagcgaagcgtctgcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggagcctgagtcctgggccctgtgcctgcttcttttcctgggaacagccttgggctacccaccactcccaaggcattcttccaaatgtgaaatcctggaagtaagattgcaccttcttcctctcctgatcaacatcggtatgatgtctcctgttgcctcaccctttgtctgcagtatcactggataggactggtggaaagggagcagcctgacagagctccaaatgtggagaatatggcatccctccacctatatttgatgtggacggtaaggctaggcctgcaggatcccttatcctgaccaaagactgtgttggggtgccatttgaaaatcgcagggttgcaaaagaatacaatcttacttgcaggtggatattctctatactctcttttaatgcatctaaaaatcccaaacatcccctggttggtgatcacttacagttgtgtccacctttattttatgtactttgattaaaaaaaaaaaactttttgttaatataaaa

SEQ ID NO: 34071 - DNA, 9942 bp, Homo sapiens
gagagcgagagtgagtgagtgtgagtgcggggtggggtggtggccgttacgttcggggcaacggctacggcagtggagaagtaagaagagaaacaacgtccggcgcttccgccttcgcttaggaggaggaagagctggtagggaaaggaaagtgcttcgccctgggcctggactggaccgagtcgggttggtgggggtctgggctatgagcttttgagggtcgcctgggacgcggagcgagacacgagagccaggagctatgtctcagccgccgccgccgccgcctccgttgccgccgccacctcctccccctgaggctccacagactccgtcgtccttggcgtcggcggctgcttcgggggggcttttgaagcggagagaccggagaatcctttccgggagctgcccggatccgaagtgtcaggcgcgtctatttttcccggcctccggttctgtcagcatcgagtgtaccgagtgcggccagcggcacgagcagcaacagctgctgggggttgaggaggtgaccgacccggacgtagtgctacacaacctgctgcggaacgcgctgctcggggttacgggggcacccaagaagaacacggaactggtaaaggtgatgggcctttccaactatcactgcaaattgttgtcgcccatattagctcgctatggaatggacaaacagacaggccgggccaagcttctccgggacatgaaccagggcgaactgttcgattgcgccttactgggtgaccgcgccttcctcatagaaccagagcatgttaacactgtgggctatggcaaggaccgctccggaagcctcctgtatttgcatgacactctggaggacattaagcgggccaataaaagccaggaatgtctcattccagtgcatgtggacggggatggacactgcttggtgcatgctgtgtctcgggctctagtaggccgagagctcttctggcatgccttaagagagaatcttaaacagcactttcagcagcacctggcccgatatcaagctctgttccatgacttcattgatgctgctgagtgggaggacattatcaatgagtgtgaccctctgtttgtaccacctgagggtgttcccttgggcctgaggaatatccacatatttggtcttgccaatgtgctacatcgtcctattattctgttagattccctcagtggcatgagaagctctggtgattattcagccacctttctacctgggctcatccctgcagagaagtgcactgggaaagatggtcatttgaacaaaccaatctgtattgcatggagcagctccggtagaaaccattatatccccttggtaggcataaaaggggctgctttgcccaaactgcctatgaatttgcttcctaaagcatggggtgtgcctcaggaccttattaaaaagtacataaaacttgaagaggatggtggttgtgttattggaggtgacagaagtttgcaagataaatacttacttaggcttgttgctgctatggaagaagtctttatggacaaacatggtatccatcctagtttggttgctgatgtccatcagtatttctacagaaggactggagtgataggagttcagcctgaggaagtcacagcagctgctaaaaaagcagtaatggataatcgccttcacaaatgtttgctctgtggtgccctttctgaacttcatgttcctccagagtggttggctcctggagggaaattgtataacctggcaaaaagtactcatggacagctgaggactgacaaaaattacagctttcccttgaacaatttggtttgctcatatgattcagtgaaagatgttctggtaccagactatggaatgagtaacctaacagcttgtaattggtgccatggcacatctgtgcgaaaggtcagaggagatgggtctattgtgtatttggatggagacagaactaattctaggtccactggtggcaaatgtggttgtggattcaaacacttttgggatggtaaggagtatgacaatctaccagaagctttccctattactttagaatggggtggaagagtggtcagagaaacagtatattggttccagtatgaaagtgattcatctttgaatagtaatgtttacgatgttgcaatgaaacttgttaccaagcactttccaggtgaatttgggagtgaaatcctagttcagaaagttgtccacactatattgcatcagactgccaaaaagaatcccgatgattatactcctgtaaatatagatggtgctcacgcccaaagagttggagatgttcaaggacaagaatcagagtctcagctcccaactaaaattattcttactggacagaaaacaaaaactttgcacaaggaggagttaaacatgagtaaaactgaaagaactattcaacagaatattacggaacaggcttctgtaatgcagaaacggaaaacagagaagttaaaacaagaacaaaaagggcaacccaggactgtttctcccagtaccattcgtgatggtccatcctctgcacctgctacacctaccaaggctccctattcaccgacaacttctaaggagaagaagatccgaatcacaactaatgatggacgacagtccatggttacccttaagtcttcaacaaccttttttgaacttcaggaaagtatagccagagaattcaacattcctccatatttacagtgtattcgatacgggtttcctcctaaagagttaatgccaccacaggcaggaatggaaaaggaaccagttcctttacagcatggcgacagaattacaatagaaattctaaaaagtaaagctgaaggtggtcagtctgctgcagcacactcagcccacactgtgaaacaagaagatattgctgttactggtaaactgtcatctaaggaacttcaggagcaagctgaaaaagaaatgtactccttgtgtcttttagcaacattaatgggagaagatgtatggtcttatgcaaagggacttcctcacatgtttcagcagggtggtgtattctacagtattatgaagaaaaccatgggtatggctgatggcaagcattgtacttttccacatctgcctggcaaaacctttgtctataatgcttctgaagatagactggaattgtgtgtggatgctgcaggacatttccccattggtcctgatgttgaagatttagttaaagaggctgtaagtcaggttcgagcagaggctactacaagaagtagggaatcaagtccctcacatgggctattaaaactaggtagtggtggagtagtgaaaaagaaatctgagcaacttcataacgtaactgcctttcagggaaaagggcattctttaggaactgcatctggtaacccacaccttgatccaagagctagggaaacttcagttgtaagaaagcataatacagggacagactttagtaatagttccactaaaacagagccttctgtattcacagcttcttctagtaatagtgagcttattcgaatagctcctggagtagtaacaatgagagacggcaggcagcttgatcctgatttggttgaggcccagcgaaaaaaattgcaggaaatggtttcttctattcaggcttcaatggacaggcaccttcgggatcaaagtacagagcagtcaccatctgatcttcctcaaaggaaaacagaagttgtgagttcttctgcaaagtctgggagtcttcagactggtttgcctgaatcttttcctttaactggtggtactgaaaatttgaatacagaaacaactgatggctgtgtagcagatgcactgggagcagcctttgccacaaggtcaaaagcacaaaggggaaattccgtggaggagcttgaagagatggatagtcaagatgctgagatgactaacacaactgagccaatggatcactcttgatttaattagaggctaataaaggcagaatgtttattgtgaatatgtaatatttgttggctgggccacgtaacttgattagtcattaaaaatcttgtacgtatataattcaaagattatatcttgttattcagtgcatgatagcaagtgtgtgattggccatagcttttaatatactgctgcccaggctggctctgaatttctataaattagctgttagatctgctgagatgactttcttccatatatgtggttcattggaagttctttgtaattttaattccatgaaagtcttaatgtttccaacatgaaaattctcttacttaaatacgtttgatttctgaaaagcctacaaatggaggggaaatgagattgtgctaatgttgatgtcatcaaggtaaccatctcatatactagtgtcaaaaggtttatgtaaacttgaattttatctgaactaaattgtatcttaaaattcatacaattatttattagacagtggaatgcaaatgtttctatgaacgtaaacacattcatagagatttcttggcgaaaatatcttgagaatagaatgtaacgatataacattttgctgatttgtgcaagattggggaaaaatttcttctagattgatgaggtcaatgtgattcagttgtgttgctgtctgagccacagccaattgtgtgtgctctattaatatgttaccattatttttgattcctggcttggtcaagaacaacctgatttttttttttttaatcttgcagaaaagttgattgcaaagtgtggtagaaaaagaaataatggtagcagtagagaatttataaataagagtttatctttatgaatgagttaattgttctacaattttgatcagtggtatttaagcctgtatatgctaagtgtatttatgcccctttgagccaaaatttttttttttttttcagaatccataagagtttatttgttggcttcacttgggtttagatgcaaattttactgcatcacaccctgatcagctgggtatttgcttagtgtattcatcaaatcttcagtgccagtttccttgagaagcagctttcatgcttattccttaaaaacaacagaagagtgtttatcctgagattggtattgcactattttattttattctgcaaatctgtatcctgaagtgtacatttcaacccatattcttctctgttcactgaaattaagttgaatttgaatggctgaaagacaaaatatatgttaatacaatctcttacctagagcattcaaagcctggctgtctctgtttgcacatgtaacagatgcagaactgtgtttgtaattctaagaaaatgtatgtcagaaagtattttatcagatgtttaaaaatctctgcctgttgattcataagggatatagacagtactttaacttgtgtttccagataaggcagattttggtcatctttctgtgaaagtatctctaactgaatccacttcttaaacaaactactctattttaaataaggaaagaatggagaatctagacattttacaggtgtatctgagcaaaatatatatttgggttagtttttatcacattatcacgtttgtctttatattttatcttcatcctaaattttctccctatcaaaacagcaggaaatttttaaacttttatattgtacactatttttgcataaaataagagctgtagctaccaaatactatttactacttagtaaaggtggcttctgtgtattaaactacgaattacaaatatcacttcactaaccactataattatttttggctttttcagccactggaactttttttggggggatttaaatacaggaaaactgtttaagcaaaaaatgcactgctttcatgtaaaatgatataatcttctttaacaaatattttcttcattgataactgacagatatctcatagcattaacataaaataccagaaacaaactttatctccctattcttacatttagtgcaaattggaatgcgtatgtgaatgttagaagatggacttaatctctgacaactttattaatttctctagctacagcaatgctatttaaaagccagttaggtatgaatagtacagtaatagtttgggttctcccttgataaatgaataaaaggctcaattctgataagtgatcaaatttcttgaaattctttcaaatcagctgaaaatttggttggggtgaattgatggtttttgagaagtaggccaggtatcctcacaaagaagttttagaatagggtttcttttaagtttttaaatatcatcctttgtctttccatatggttttcataaccaaatacatgactatagcatggttatttttctagtactgccatttgtgatatagccacatcttggcgtgcaagctagacatctcaggtaaatttgtttttttttttttttttagccctagaggtaacattataactaaaatgcattcctgcaattctgtttgcagtgcttcactaaacattgaaataaagttgtaaattttttcttcagtaatccattttatagttaatcataccaaatttaagttgatgacctaaagtccaggtagtgttgaagatagtatgtatctagaatactggtaatgagaaattgttgtaaattgaagaaaacaagatgctgccatatattaagatagaatataattaactccatgagaatggttactcaggaactagttaaagagcaaacccatttctcccgcttcactctgtttcagatatttttattggaaaatgttagggtagaggcctgagaaagttagcaaatgctattgactgatactggctctgtgtcttccagtgatttttagtttggtttttacagtcaagcctactgcttgcaattaagatatcaatctgaaatgcatctgtaattcctggccacaggtccttattgccattatttttaagtatcttcattggagatgaacactgacttttgcatatggtctcttacctcagggaagatcacttgctagcaactcatactactaatgacaggtttttgagaattgtactgacatcacatgttagctactaaatgcaaaatgtataaaagtattgttttatgtagttacctaccaatactatctgctactgaataactctctaaatatgtagacctcactaataactaacctttaggtaaaaaatttacttctgtcattaattacacttcaactggtcaatatagtggcagcataaagtgtttatttcagaatatcaatacagttttgtcttcatttttcaacagtaatttcaattggttcatacttaaaatactacacagattttgagttttatggttctcaaagcaaggtttccatcttaagatttttataaacacaaagcctttgcaaaattggattaaattccacctatcttaatgtgaattaaaaaccaccatttataataataatagcgccatattctaagttgagtaaatgcatcctaccattcaaggttatcatataatttaacaaaattgtacaaccttaaggctcttcacagtataaattaatttttcaaaccagagctgttcacatgaaaatattccttagtagaatgtatatttaagaaataaaacaacaaaggggaactatatcacccatgtaagttatagagttaattacaagttctaccattcttgataattctttgagatgctaagtgtttcagttcatatttaatgatacttaaatcgtgggaattttaatgtttgttccaaaatagcagaaattgtaaaaattatgaattattggagaaaatgccattacttgtatatctgacatttaattttttaattatggagactacatgcttttgtagtataatattaatgattattctcttgtaaaagaaaaggaaaaattagtaaagaaaaaagttttagttgatgttacctgcttgtgagtatcaattacttagtttttaaatttttaaggtattgcctacttttctttagaatgcagaaatctcgtcctgagcccttattatgcctgtggtagagcaatgcaagactgaaaaggttgccagtattttcaggcttatttgactaagaattagtgccaagaactggaaagtctactttttggagggaaatgatacttagaatttgtaaacataagcagtaatagtgtaaatatttagaaaaatagcaagtgctttaactgctcaataaaatagtatagatgttatttcacccttaaggcactggctgttgcccattattttccgatttcgtgattactgtatatattacatttgagtaatgaataattggtaatagtgtattatagtgttctacagcacaccttactgtacagtatttgaagttttcttttatatcaataataaaactataagttaatactgattttcccctgaaattctccacattagcttttaaaggtaattttatgttctttagtttcctggaattataatgcatgaacatatagttcagttttataaagaaattcttaaataataaagttttcttgttgaacttaagcgggttatcgtacaggaatagtgatttttccccttaatgtagatttcattgctagatgaaatggacccagtgaaaaaagagtgcgcaatttaaaaaaaaaccaaaacggtctcactctgctgcccatgctggattgccgtggcatgatcagggctcactgcagcctcaacctcctgggctcaagtgatcctcccacctcagcctcctgaatagctgggactacaggcatgtgccaccacacctggctaatttttgtattttttgtagagatagggttttgccatgttgcccaggccggtcttgaacccctgagctcaagtgatctgccctcctctgcctctttaagtgctgggattacaggcgtgagccaccgcaccctgccagcaaaatttctttagacatattacataattgggccataatgcttactgaatatttaaaaatgaaggcaaattctaacagagaacttgattttgtggtggtttaaaaaaatactggttagtgataaggaaatgaaaggaaatacagataatagtactaaataacgtttgtgtagcttagcagtcaacacgtttacttccaagttttattgtatatgcttaatatacattttattagatcatttaactcaataatttagagtatagccttagacaccagactgcctaggtctgactcctggtacgctgctttctgtgacctctctgtgcattcctctctgcgaggatgatgatcacatctgctcccagggtggctgtcttaaatgagttaacacgtatctgatgattagaagagtgcctgacacatagtaaacactcaaatatttgctatgttatatgttaatgtaatgtggtagagttcagttgccattaagtgggataaatcctcacagggcacacattatttaaataatttgttacattaaaacttattttacttgtacataattgactaaaaaatggggggttgtacattcaaacatttatgaccatgtgcaacactgagaatctcaaaccgacagtgtgctctgtgacccaaggcaagtcttggagcctttcaaggcctcaatttcttctgtaaccttgtggtttcacaattgtcaaccttttgttctgccgaccattgtcgtcatagtcttacttgcagagggcatagtgctgatgggacaagtgacatgggtatgagccccatgtaaactaaaacataattacctttcctttaggtgttggctacagttatcccaaacttggacttgaggtcttgtatatgcatgccattggtcacataccatcagaatagaattctcaaaaactctttagtaaataagataaacatcctacttataacagctcattatggattttatttttattgtctggctctttcagaccccagcaactgcaattctgacttaataatcaattgtttctaatcattaaaaatgtatatagaaaaactgaa

SEQ ID NO: 34072 - DNA, 4312 bp, Homo sapiens
cacaaggtgcccgtggcggcgcctgacgggagcgtcgtgctcaggggtgtcctctcgtcctgcgtccgcgcccagcgccccgcgccccgcgctgttcctcgtgagaccggcgggcggcgagccgcgcggcccccggggcagtgtcggacacggcgggcgcgcactcgcaggcggggcacggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 34073 - DNA, 4312 bp, Homo sapiens; identical to SEQ ID NO: 34072

SEQ ID NO: 34074 - DNA, 804 bp, Homo sapiens
ctcctgagagccttccacactccccgaagccccgcgatggtggatagttcctcttccccaggaactccccactgacactgcccctctgagagccaggtcctcggctcctgacagcctgcctggtcagaccctcagtcctatgggactcgggtgtctgcggcgaaggagctcccgtgagggtcccctctctactcaaacataggacccacctcgatcccgcagtcttcccctgtctctctttctccttaggtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactagctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatac

SEQ ID NO: 34075 - DNA, 804 bp, Homo sapiens; identical to SEQ ID NO: 34074

SEQ ID NO: 34076 - DNA, 863 bp, Homo sapiens
gaaggagcggggactgttccgtggcattgaggacaaccccatggtggtgccactttgcaaccggtcgaaggacgtggtagagcctctgctgcggccgcagtgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccct

SEQ ID NO: 34077 - DNA, 4312 bp, Homo sapiens
cacaaggtgcccgtggcggcgcctgacgggagcgtcgtgctcaggggtgtcctctcgtcctgcgtccgcgcccagcgccccgcgccccgcgctgttcctcgtgagaccggcgggcggcgagccgcgcggcccccggggcagtgtcggacacggcgggcgcgcactcgcaggcggggcacggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactagctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 34078 - DNA, 1541 bp, Homo sapiens
cacaaggtgcccgtggcggcgcctgacgggagcgtcgtgctcaggggtgtcctctcgtcctgcgtccgcgcccagcgccccgcgccccgcgctgttcctcgtgagaccggcgggcggcgagccgcgcggcccccggggcagtgtcggacacggcgggcgcgcactcgcaggcggggcacggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatg

SEQ ID NO: 34079 - DNA, 804 bp, Homo sapiens
ctcctgagagccttccacactccccgaagccccgcgatggtggatagttcctcttccccaggaactccccactgacactgcccctctgagagccaggtcctcggctcctgacagcctgcctggtcagaccctcagtcctatgggactcgggtgtctgcggcgaaggagctcccgtgagggtcccctctctactcaaacataggacccacctcgatcccgcagtcttcccctgtctctctttctccttaggtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatac

SEQ ID NO: 34080 - DNA, 3627 bp, Homo sapiens
caggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 34081 - DNA, 804 bp, Homo sapiens; identical to SEQ ID NO: 34079

SEQ ID NO: 34082 - DNA, 863 bp, Homo sapiens; identical to SEQ ID NO: 34076

SEQ ID NO: 34083 - DNA, 804 bp, Homo sapiens; identical to SEQ ID NO: 34079

SEQ ID NO: 34084 - DNA, 863 bp, Homo sapiens; identical to SEQ ID NO: 34076

SEQ ID NO: 34085 - DNA, 863 bp, Homo sapiens; identical to SEQ ID NO: 34076

SEQ ID NO: 34086 - DNA, 4312 bp, Homo sapiens; identical to SEQ ID NO: 34077

SEQ ID NO: 34087 - DNA, 804 bp, Homo sapiens; identical to SEQ ID NO: 34079

SEQ ID NO: 34088 - DNA, 1855 bp, Homo sapiens
agagccgcccaccgtctctgcccgctcgactcctccgcccgggccgctcggccggtccagccgcggccggcgcctggctgtgaggtggattcccggcccagtctgaccatctccctccaccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacagggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtatt

SEQ ID NO: 34089 - DNA, 863 bp, Homo sapiens; identical to SEQ ID NO: 34076

SEQ ID NO: 34090 - DNA, 863 bp, Homo sapiens; identical to SEQ ID NO: 34076

SEQ ID NO: 34091 - DNA, 284 bp, Homo sapiens
ggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatac

SEQ ID NO: 34092 - DNA, 4312 bp, Homo sapiens; identical to SEQ ID NO: 34072

SEQ ID NO: 34093 - DNA, 2336 bp, Homo sapiens
gaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtcgcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccac

SEQ ID NO: 34094 - DNA, 2336 bp, Homo sapiens; identical to SEQ ID NO: 34093

SEQ ID NO: 34095 - DNA, 1855 bp, Homo sapiens; identical to SEQ ID NO: 34088

SEQ ID NO: 34096 - DNA, 1855 bp, Homo sapiens; identical to SEQ ID NO: 34088

SEQ ID NO: 34097 - DNA, 1855 bp, Homo sapiens; identical to SEQ ID NO: 34088

SEQ ID NO: 34098 - DNA, 2336 bp, Homo sapiens; identical to SEQ ID NO: 34093

SEQ ID NO: 34099 - DNA, 2336 bp, Homo sapiens; identical to SEQ ID NO: 34093

SEQ ID NO: 34100 - DNA, 1855 bp, Homo sapiens; identical to SEQ ID NO: 34088

SEQ ID NO: 34101 - DNA, 4073 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaa

SEQ ID NO: 34102 - DNA, 1029 bp, Homo sapiens
gttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctg

SEQ ID NO: 34103 - DNA, 3605 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 34104 - DNA, 460 bp, Homo sapiens
acgctgcgggtcctgggcccaggccttgggatgggcgggaaggcttggccgcgccgggctgtgggcactgcaggaggcccctgtgcagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccg

SEQ ID NO: 34105 - DNA, 1103 bp, Homo sapiens
cgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatgga

SEQ ID NO: 34106 - DNA, 3609 bp, Homo sapiens
ggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 34107 - DNA, 3377 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 34108 - DNA, 1729 bp, Homo sapiens
tcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgggtataactccaccagggaatgctccgactgtcacttcaatgagcagcatcaacaacacagttgcaacacctgccagttatcacacgaaggatgaccccaggggactcagtgtgttgaaacaggagaaacagaagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataa

SEQ ID NO: 34109 - DNA, 6815 bp, Homo sapiens
tcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataaatgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttctttttttttttgagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattcgagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaagcagtggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtggtctaaattcttgatactgtttataattctacaaagaacaaaaattgttatgtactataggcacttaagaaccctgaggaaaaataatacaatgtgtgtgtgtgagagagagagtgagttactgacattgttccaaaaaaaaaaaaaaaaaaaaaaaaaatgtggagggttgaaatggtaaggaattggaatcttttgtattttcgagcaataagaattcctattcttgtttcaaatagaggtttgttaggaattacagttgtggggagcaaactttcttttttgtgctgttttaattcaaaatgtatatccttaattgtatataatatgtagataaatatatgagggtattaagctactttgaattaaatttaaggatatatttcacatgaaaacaaatacaaacgagaatcaaaataaagttttgcaaagta

SEQ ID NO: 34110 - DNA, 1834 bp, Homo sapiens
gcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaa

SEQ ID NO: 34111 - DNA, 7936 bp, Homo sapiens
ccccgcccctggagccggcggcgcagggcgcagcttcccgccgccagagcgggccagcctgctgcgtgcgtgcgtgtgtacgactctgcgtgcgtgcgtgcgtgcgtgcgtgccgtcagctcgccgggcaccgcggcctcgccctcgccctccgcccctgcgcctgcaccgcgtagaccgacccccccccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctatggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacataatgaaaaaaagaataaggcaaagaggaggtgaatatggggcctgtcacaacggcctgccctgccccaagagggttaagagtcagataatcgggacgaaactggcatggaaagagcgagcctagggaggatgccgctgggcagtgtgcatgggggagctgctgccaggctgccctccagtctgctcctgtggttactggctccacagcacctcagagagggcggccctggcttcagaaatgccagccatagtgctcacaaatgcagaagagatggaagcggtgacagaatcctgaaagtttttattgattgaagttttaaattggtaacttaagcttccttggcacgatacaaaatacctcttaaagacagcaggcttttttatttgtaggtgtgaggaactggctttaacttttttctcctcctagtttgcatgttttccttctctcgtcttctgaactgctggcaccagcagtaatacatactgataaaatcaaaattgatttttaccagtggccagtttatggctagagagacgacttatacctccataacacagaagggggaaaaatgaagaacctccagtgatccgtgaaaacctaaacgctttcaaacaaatcccaggaacagaattgctatcgaaagatatcattgcccagtttgcaggctatgttgagtcagatagaactgaatgtagtgagagctcagagctacagagcctttcagatgaatttgaaaacagactctgtgtgtgtgtgcatgtgtgcatgtgtgcatgtgtggcatatgtgccgtatgtcagtagcttgacagttttcaaatcgtgcctatatttttttgcatacacaaatttttgtgtttgcaaactcagaatccatgccaaaatacaatgttatatgtcattttcagctccttctctaaaggaatggcccatttctcattgtagtttgagaaatacatgtatgaagagataggggtcttgggcttcccagtgtcactttgaacacctgaataacatttaactcctgagaccttctcggtgtagaggccactgcttccccctgctggagatggcatttcattgaagggcctctcgtggctttccctgcccccggctgtctggcctgaagaaggagaaagaaccaaactgaactatgaaaagttaccactctgaggagacctctcttaattaacacttggggccatgtttgctgttgttgagaaggagtgttctcaaagatgagctggaatggaattgtatttagaaaggcccctgcaaagtatatagatggatgactctagttcatgacatacaaatcccataaggccaacgaccactcttctggaacaccaagagcagctctgagatcatgctggccctacgcgaattgagtttctgtggcctaattggatttggagaacgccttccctggccccttttcctcagacagatctgctctgataggaaccttttcaagaaagttactgttgtttcaatgccactccttacctgtatagaacatttccaatacattcgctcattgaacttaatccttgcaactgtgactggggggtagatggctctgtttgcatacgaagaaataaaggctccaggaggttaaatcgggcaactttttagaactaaatcagtctctgtaaggcctacattgctaagataccatttcagctctgaaaatctgcttcagggaagtgagtggatgaggccttcctgcctcagctactctgcccgtctgtacatcttttgtgtctgcctccgtaccttattcagttattttcacactaaagtaagtagaattaagactgtagttcagatgctttttctttttctgttggaaactgaacacactacagacagtgaaaaaaggtacatattccattttctcattgcctgaagatctctgctgatgctcctggagaatgactttgggggctttagaaagaatattgccagtccgtctcggcaaggagatgatgggagcgctttatatggaggctttacatgacttgtaaattaaatgtgaatgagggcagttgattaaaattggtattacagaagggccctgctgaggtttgaaaacagctgagctgctgatgtctcaggcctttccctgaattagcactgcggttctccaggatatcagcaaagagggcaagtaatagaagcccctgataaggagcgtcagccgacaggcaagcttgggaggctgtgggaatgggtctgcccccagcttcacagacctcttcctccagcctctgaatcccattagccacagcctagaacattagctgagctgcacaagctcacccacccctgtgccagggggccctgacctccctccatgccatgtttttggctgtatctacggcacttaacaataggggctttttattttcattacagagatattttgaaaaatttaaaagacatgaactcacataaacagttatggatgatagttaaaagagaaacgggtggaggtggatgagaggttgtcttcatgaatataattacttgagatttttttttcttaatggaattagtttattagaaaatgtctgtgttaaatccgtagaaaaggaagaaaagtgtagcaacaaaaatgtagccattatctaacttgccataaatatttgcagttatgataccttggaatgttgccacgatatggattgctttgattaaaagatgtcagttgaataaaacagtactgtgggagaatcgctttctgctgctagataaatgctgatgtttatttttaaaccaggaaacattgatcctgtaacaatgcccgattacaattgctttattacaccccagggctgatggagatgtaatcacttggctaatggatgtgggtgcaggacagatgctcgcttgctggcctgctttcctgcttgcattctgatgagctgcaggagtgcgcctggccttctgcaggtggagctgctgtcagagcttcgtttcactgatacccaaagccatgtctgactgaaataaaacaggttccctttttttttccctttggaaaatgccaactaagggagactaatcagatatcttaacacaatttcatccaggcttagtgctaacaagattgcggggctttttagggtttaagaagatgagaaatgagtgtgcacgtttcacacgttgacttgccggtttttccatgtcatacaaaaaagtcctggctgtttctccgaactggctgcctgcattcccgtctttcttttgtttttaagaaatagactgaattcagctgttaatcctctagtacagtatccatgttaaaatgtttttccattgcatcttttatgtgaattcaaaggtcagaatttattgtctgtgatattgagaccatgtgtacaagaactactttttgcttttcatcattcactccttagcaaacgtttcgtaagtaccctctgtctgtttgctactatatgaggtgctgcgaaattagtgggcgtggctttttatatttttcattcgtgtgtagcctaagtaaggtgactcaagatgatacaccgagagaaaaatgcaaaatatatttggttctcatttctgttgctgtcgtttcctttttaaagacgatttatcaactgctgccatttggaacttcctataagaaactaaaaatgatctatttcagtgttcctttcgcctttcctctgctttctgaataaatggtttcagtaacccatgctgttctctccctattctacgtctttctccctatgttgaaaaaagattcccacagtttctgatgtgtgtgtttatagtcttcaatgtatgttaacatgttaggaactgagtatcttaagagatgtcttagaatgctttagttttcataatttgtcctttatgtatttttcattgtatttgctgttttgacatggaagtaatttaaaaagttggtgcaggaaaggactctttactgttgcacattttggttttctgatatgtaataaattcatggcttggcagctgacatgatgtttcccagagagaaggagatgtatttctgcagggtccagaccaaaagagccatttacagcatgttctcccatgttccattatcagcctgatgaaacctgccctgccaaggcataaacttttgtactagctgtctccatattatgttcaataaattctgtgctctgaatatatttaaa

SEQ ID NO: 34112 - DNA, 2265 bp, Homo sapiens
ctcgctcacaaaaaattgagccggccctggaggcctggggggcgagtccggttgcgcctcggagagcgcaacaggcagaatttgttcctgttgaagagtggctcctcttctaatttccagactccttgaggttttaggagtctggtaggtgaaattttctacctctaaggagaaacagtacctgctccttcctcaagcgcaagccctccattgctatggataccgaatccacttattctggatattcttactattcaagtcattcgaaaaaatctcacagacaaggggaaagaactagagagagacacaagtcaccccggaataaagacggcagagggtcagaaaagtctgtcaccattcaacctcccactggagagcccctgttgggaaatgattctactcggacagaggaagttcaggatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatatatctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactaattcctgcctttcgtccagtaccaagtcccccgttgcttctggtcagcccacttgtagacttccaggggacacatctttattctgtttcaggaaaccagtcacgacacgtccacatatgtatttgtgtatgttaatgtccagtatcacatcacccatgaaagt

SEQ ID NO: 34113 - DNA, 8691 bp, Homo sapiens
aggaagcggaaagcagcagtgcagcggcggcggcggcggggctctgcctctccaggagcccagcgcaggccgcagagccggggccgctgtgagccgagaccgcgggccgcggagctcgggcggccggcgcggagaatttgttcctgttgaagagtggctcctcttctaatttccagactccttgaggttttaggagtctggtaggtgaaattttctacctctaaggagaaacagtacctgctccttcctcaagcgcaagccctccattgctatggataccgaatccacttattctggatattcttactattcaagtcattcgaaaaaatctcacagacaaggggaaagaactagagagagacacaagtcaccccggaataaagacggcagagggtcagaaaagtctgtcaccattcaacctcccactggagagcccctgttgggaaatgattctactcggacagaggaagttcaggatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatatatctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactaattcctgcctttcgtccagtaccaagtcccccgttgcttctggtcagcccacttgtagacttccaggggacacatctttattctgtttcaggaaaccagtcacgacacgtccacatatgtatttgtgtatgttaatgtccagtatcacatcacccatgaaagtcgtgggcagttcaggagatacctgccttcatctttgttctttgttgccttaggttcttcagagaaagatcacaacaaaaaatgtacactgtcgtttacagctattaagtgatttgattttgtttttttcccaaagagaaaacctacctgccctgtttctgatcccacccctctgctggcttgaagcaggtaaccctttcccagccctgcagctgcccacctggcctccatgccatcctgcccccacctggctggcagccctggctctccatgtgtgccctccggctctgtgtgaagcctcaagtcagtcccagcattgtttccatagggaagtgtggggtgcccagcaggtaaagcacagggagagagggcagtgggaatgccacctttaggctgcagcaggagccccacactgcccagttttcctccccactgttctacaccaaccaggggagactaacactgtgactctgggattggcaggtgcaacttggagccacttaatttcctggggacgtaagttcttcccaagcttagagcaagctgccctgccaaaggagaccaaaccatgccaaccacgctggcaactgctgctgtccagtccctgtgttttctgaccaccgtcactgtgcaactcatcgcctctgccacttaggaccaggaaagaggctggttttgctcccactcttagttgctgataaagtggggagaaggaaaatggacactctacagagtttggggaagggagagtagggagcccatcttgtccagaaagattcatctgtggtctgtctgttaaacacagctgatttcagtgggctttcccctggccctgggggagcagacactgactgggttgtgggcagaggagccatcctggcggagccctgctgcaggggagctccttcaggagccccatccggacctcttgcactgggctgcctttgcctccatttgccttcctgtatctgcaacaaaccttttaaaagtgttcactcttgctttttccagtatttcggtaatcagccatcttgctgtagtacaggatgacattgtcgaatgctctttgtatgtgtgcacacccccttactcccttactgcttcatacactccacaagtggtacagtattttgtgtcattgtaaaaatcaaaattggctttggatctttgtaatacacctgtacctgaaaaagtaaacaacattcttcaattactagccttcagcttgaaaagacatgctggagaagaaggaagggggaacccataggtgtggcgtggagccaagatgtactattcaactatgtgtttctgtttataaaaaacacataccatggaaccatggtgcttttgttcttagtttttgccgttagatcccttcaaactggaagttccttacaatatctttctcaggaaatattttgggaaatggggtaagagatggcaagtgtgagacgggctgtgtcagaggttgctacgtcatggatacagtgcagttccaagtgccataagtgtatgtacatatagttaataatgacactgttcatcaccattctaaaatactgttcttccaaccctatcttcaatgaccagtccagaaggggttaagctggattcatttgctctggcatgtgcattcccagcagggtgaagaaaggtttaaattaaagaatttattttctctctcccccttcctctttctcccagtctttgcataggagaatgttagacattcagaaattactgtttctgttttaaattgagtattgatttttttatattgactttgtattgagttctttttgaaagaataacaaaataaaatgcaggatctttgtaaagcctttgcactttcaacctctttatagcttgagttacttttgcagtgggaacaatgtaaatgacatttaaaagatttaaggtttcagaaagctgcatcccacaattgaacacaatgcatttttatttcaattcttggaactggtaggctattctttttaaaagggggtaaacttcgccctaaggctggtagaatgtatgttcacattatagtagacaggatttcatttgccttatatgtttatagattttttataattttcatcctacgttattaaaattagagcattgagtgttaaagaacttaatgaggagtctatatctgagattgctctcttccctggtgatgttttaactggtagataatttgttcttaaatatgtacttttgaagataggacagtttttatagtccatgaactgaatgttaaaaagttctgtatgcattctcagagaggattttaaagctatatagttcatccatcctttgcattatcaaaatgttaagtcaaatctgtaatactttggctaaaattcataaagtaagccctagagaaaatacttgaccaccaaatttttgcccaactatcatcacctcccttcccccgcctctgttcttgccttttgacatctacatggaagacaagttctttacagcaaatggtaagaggcaggtgacctggtgtgtttgctgtgttgtagttcattgcctggggcttgggactccttttttaatggagagactagctgtgcaggtgtgtgttggatagggataaagtgctcacccctgccctctctacagtagttggtggtagatttctctctcattttgcctcataatcactttcgagtgcatgtatttacctaagggctgtagctctgtgggatgctaccagcatattggactgacagaaattgattaccttgccactccaacctacgtactgagtgagtgctccagccactcagtgaaaccaacaaaagtgagtccttggtttaccttccaatctgggtcctgctgtgtaagtatccctaagtggggatgcatatttgtttgtgcgtttttatttccatatatgtgagcatttctctgagtgtattaccagacggatagcacatttatatgtcagacatcttaacatctgtgttatctgtagcaggtgtgtagctcagcagatacgtgtcattgtgtatatagctgagtgtgtgagggtgtctgtgtttctgcagtcccctgtgtttgagagatgacttaataaccctgtgttttgagaggtcgctctaaaccagtgacttttccctcccctgctttattcctttccctcactgacactggcttctcccgctagagtaaatggctttagcacagcactgtcttctggggagcctgctgtcctgcaggcaagtccattaaactctttcttgctttaggactctgaaaacagcaagaaacaaacaaacaaaggtcaagctctaagaaaattactgctcaaacttcactaccctggaagccttactagatatttcttaaggtaacttaaaaattgggctttatttttaaaaagtgataggttacttacagtagcacagaaatgttagcatatttatttaaatagtcctgcagcagagaccctgcgattgtaaagtgatttaagtatttctgggtagtgtttgtgatttacggatttgttactgaaaaacaaaaaaatcactactgtgaatttactactatgtaaccttgtggtcgtatttcattataaataaaataagaattgctcttctgcccaccgttcttgattggtattcagtgcagtagcgaaatgagatagtttagacactgttgaaataactgcattgagctttaaccaagtgtatgctcagaaaattcagttttggatcacattttgacaaaacatgttttggtcaaagaaaggaaaggctactaacacatttatcaggtaatgtatgtcacagtccgtgttccacccagccttgttatccccacattctttcaagataggagtcatcttggtttttcgggtgaaaaacggaaggtcagagaggaaggggcttgtccaaggtctcatgtctggttaacagaatttcaaactagatgtttgattctaacccctcagtccactgtaccttgaagtatggtctaaatgattcggcacttctggatgttgaggaaggacctagagacacatccttgaactagaacctggggtgagagttcattgggaggcaggatctcttctttcactttggatttacaccttgtcccttggaaagcttctccactatgctagcaaatatcttaggatatttgatggaaagaacttgagaatcccttctggaaaacccagcctttcagtgttaacacctgctgcaagacagggatgctgttgttctggcagcccccctttgcttttgcctggccccaccttctgctcccactctgctggcttgggcaagatgcgtgccttgggccttgggtgcagggaggcaggcaggggcttgacctggcctctctctggtgccatggcaacattatgccccaaacttcttccctggttggagtgagaggggctgtccacagccccatcctgtggggatctcaagccggagtccctggcctggcctccttgacgtaggtgttctcagcaagcagtttgcatcccaccgtctttctcacacttgcccccaagacttttgacagagcagacgtaaaacaggactcagaaaaccatttttctctgttcccatatgtagtaagttttgattcagttgtgcataaaccatagttttctgccctgctgtttgctttcaatggaagacagtaaagggaagatggtgctcacatctctccatgtgacatctcattaggaattaagatgcgatggattagaaatgtaaaacttcagaataaaattaaatttcagggctctataagtcccgttttcccaggtcctgttccgtttctacgtagataacccaatttgttttgtctatgaaataagcctctttagtgggttgttttagtctctccaacaaaagagcagattcctaaagccaggtgcagcactgtgaaaagtttctttcaatatggcaccaagactctaccatttatgtctctctcagcttacaaacatcagcgttttgtccttgtcatagtggaagaaagacacttactttaagctttggggacaaaggtgacaaaccccaggcttttatcttaaaagtgtctttggcacttcttttggcactgaaatggtatttgggaagcattatttgaatgtacagttgtttggttttgtatgtgcttatctttatctgagctttcacttgtagacatggccttttgttgtgaagttgctcatcatttaggagtgtttaattctaaaaagccttcagcctaagaaagcttcatctgtggggaccagagacttgttgctcagggagttagtgatgggacttgggcatctgatctgcaggtgacaagtttagttcaactgaagttgtagggaatttagacagttgcacatcattgccgttctaggggccttgtagaaagatgaaacagttgtttttcatttaccagcacctctcagttatagaggtaatggaacattcgcttacttttcatcatcattctttaaaaagggaacatacaaaaatctaaactatggcaataatttatttttataatagtttacggtaggctttaattaaatggcaaactcctctgggacccctaagttatggcgtgattagccaaatttgatttccaacagtcatttatggccataactattgcatagagtgcaggatgccagcaaagatgagggtgggggcagatactggctcagtgatttaactcacattatagatgaccccttcctcaacagaaatgctactgagagaaccagagaggcctgggccaggcaggtcttatttgagaggagattatttgataattgctttggttagaaggactttacatttcctgatttcaagtccagcaccaatttagaaagttcagagatgaaaccacctgtctttacctgacagagtcataacggtttgtgtaaaaatgtggtcagggaccttttttgttctttctgattagttaatactgtacattgtaaccaggaggggcagttttgccaaccagcctctgctcatggtcaccatatgtgtatgacaaggcctgagtgagttcctgcataaactgggtagtgggctcttttgacacatttgcaagcatgtaaatgaatgaatgacactaccagcaaccatctgtacaggtccatttacttacattcataaggtttatgctatgaaacttcttctcattgtgatgtcagtaacagagttagtgtctctgatggaatagtgtacctgtcacccaagttattttgttcctttttgggtcctccagtataatccccccctcatcccaattaactgtaaaatgttttacacatcacattttttatactgtaaacttggaaaataaactgaaatatcaaattg

SEQ ID NO: 34114 - DNA, 2062 bp, Homo sapiens
ccctccattgctatggataccgaatccacttattctggatattcttactattcaagtcattcgaaaaaatctcacagacaaggggaaagaactagagagagacacaagtcaccccggaataaagacggcagagggtcagaaaagtctgtcaccattcaacctcccactggagagcccctgttgggaaatgattctactcggacagaggaagttcaggatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatatatctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactaattcctgcctttcgtccagtaccaagtcccccgttgcttctggtcagcccacttgtagacttccaggggacacatctttattctgtttcaggaaaccagtcacgacacgtccacatatgtatttgtgtatgttaatgtccagtatcacatcacccatgaaagt

SEQ ID NO: 34115 - DNA, 4114 bp, Homo sapiens
gggctctgcctctccaggagcccagcgcaggccgcagagccggggccgctgtgagccgagaccgcgggccgcggagctcgggcggccggcgcggagaatttgttcctgttgaagagtggctcctcttctaatttccagactccttgaggttttaggagtctggtaggtgaaattttctacctctaaggagaaacagtacctgctccttcctcaagcgcaagccctccattgctatggataccgaatccacttattctggatattcttactattcaagtcattcgaaaaaatctcacagacaaggggaaagaactagagagagacacaagtcaccccggaataaagacggcagagggtcagaaaagtctgtcaccattcaacctcccactggagagcccctgttgggaaatgattctactcggacagaggaagatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatatatctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactaattcctgcctttcgtccagtaccaagtcccccgttgcttctggtcagcccacttgtagacttccaggggacacatctttattctgtttcaggaaaccagtcacgacacgtccacatatgtatttgtgtatgttaatgtccagtatcacatcacccatgaaagtcgtgggcagttcaggagatacctgccttcatctttgttctttgttgccttaggttcttcagagaaagatcacaacaaaaaatgtacactgtcgtttacagctattaagtgatttgattttgtttttttcccaaagagaaaacctacctgccctgtttctgatcccacccctctgctggcttgaagcaggtaaccctttcccagccctgcagctgcccacctggcctccatgccatcctgcccccacctggctggcagccctggctctccatgtgtgccctccggctctgtgtgaagcctcaagtcagtcccagcattgtttccatagggaagtgtggggtgcccagcaggtaaagcacagggagagagggcagtgggaatgccacctttaggctgcagcaggagccccacactgcccagttttcctccccactgttctacaccaaccaggggagactaacactgtgactctgggattggcaggtgcaacttggagccacttaatttcctggggacgtaagttcttcccaagcttagagcaagctgccctgccaaaggagaccaaaccatgccaaccacgctggcaactgctgctgtccagtccctgtgttttctgaccaccgtcactgtgcaactcatcgcctctgccacttaggaccaggaaagaggctggttttgctcccactcttagttgctgataaagtggggagaaggaaaatggacactctacagagtttggggaagggagagtagggagcccatcttgtccagaaagattcatctgtggtctgtctgttaaacacagctgatttcagtgggctttcccctggccctgggggagcagacactgactgggttgtgggcagaggagccatcctggcggagccctgctgcaggggagctccttcaggagccccatccggacctcttgcactgggctgcctttgcctccatttgccttcctgtatctgcaacaaaccttttaaaagtgttcactcttgctttttccagtatttcggtaatcagccatcttgctgtagtacaggatgacattgtcgaatgctctttgtatgtgtgcacacccccttactcccttactgcttcatacactccacaagtggtacagtattttgtgtcattgtaaaaatcaaaattggctttggatctttgtaatacacctgtacctgaaaaagtaaacaacattcttcaattactagccttcagcttgaaaagacatgctggagaagaaggaagggggaacccataggtgtggcgtggagccaagatgtactattcaactatgtgtttctgtttataaaaaacacataccatggaaccatggtgcttttgttcttagtttttgccgttagatcccttcaaactggaagttccttacaatatctttctcaggaaatattttgggaaatggggtaagagatggcaagtgtgagacgggctgtgtcagaggttgctacgtcatggatacagtgcagttccaagtgccataagtgtatgtacatatagttaataatgacactgttcatcaccattctaaaatactgttcttccaaccctatcttcaatgaccagtccagaaggggttaagctggattcatttgctctggcatgtgcattcccagcagggtgaagaaaggtttaaattaaagaatttattttctctctcccccttcctctttctcccagtctttgcataggagaatgttagacattcagaaattactgtttctgttttaaattgagtattgatttttttatattgactttgtattgagttctttttgaaagaataacaaaataaaatgcaggatctttgtaaa

SEQ ID NO: 34116 - DNA, 5340 bp, Homo sapiens
gattcctgatccttgattccttgatccttggtcccgccatgggagcctgagcgccccctattcccccctggcccccagcccccggggccttgagggggaagaggcagcggtctgggacggagcagggggtgaccagactcaagaacccccccctcaacatcccccatcgcgcgcgctgcctgtccaggagcgccgagttcggagcgacccggagcgctgcggatacaaaggcgacgggccgagcggggcgcccgcggagcccacccggcagttcgcagcggcgggagcgtcgctggattttctctgagacaagcccacccgtccagcaaaatagagtccctcagggtgacagttgacttcctgaaggtgcctcttggcctaaagaagccggtgctgaaggaggtggctgtggggccccccaagaggccccagcctgcggccctggagcgctacaaggcgcggcgttcagacgccatggacaccgagtcccagtactcgggctattcctacaagtcgggccactcccgcagctcccgcaagcacagggaccgccgggaccgacaccgctctaagagtcgagatgggggccgaggggacaagtcggtgacaatccaggctcccggggagcccctgctggacaatgagtccacacgaggggatgagcgggatgacaactggggggaaacgacgacagtagtaacgggcacctcagagcacagcatctcccatgatgacctcacacgcatcgccaaggacatggaggacagtgtccctctggactgctcccgtcacctgggtgtggcagcgggggccaccctggcactgctgtctttcctcacgcctctggccttcctgctgctgcccccactgctgtggcgggaggagctggagccttgcgggacggcctgcgagggcctcttcatctctgtcgccttcaagctgctcatcctgctactgggcagctgggctctgttcttccgccggcccaaggcctcgctgccccgcgtctttgtgctgcgtgccctgcttatggtgctggttttcctgctcgtggtctcctactggctcttctatggtgtgcgcatcctggatgctcgggagcgcagctaccagggcgtggtgcagttcgccgtgtcgctggtggacgcccttcttttcgtgcactacctggccgtggtcctgctggagctgcgccagctccagcctcagttcacgctcaaggtcgtgcgctccaccgacggcgccagccgcttctacaacgttggccatctcagcatccagcgcgtggcagtgtggatcctggagaagtattaccatgacttccctgtctacaaccctgccctcctcaacctgcccaagtccgtcctggccaagaaagtgtctggcttcaaggtgtattccctcggagaggaaaacagcaccaacaactccactggccagtctcgggctgtgattgcagcggcagctcggaggcgggacaacagtcacaatgagtactactatgaggaggctgagcatgagcgaagggtgcgcaagaggagggccaggcttgtagtggcggtggaggaggccttcactcacattaagcggctgcaggaagaggagcagaaaaaccccagggaggtgatggacccccgggaggcagcccaagccatctttgcatccatggcccgtgccatgcagaagtaccttcggaccaccaagcagcagccctaccacaccatggagagcatcctgcagcaccttgaattctgcatcacgcatgacatgacgcccaaggccttcttggagcgatacttggcggctggacctaccatccagtaccacaaggaacgctggctggccaaacagtggacattggtgagcgaggagccggtgaccaacggcctcaaggatggcatcgttttcctcttaaaacgccaggacttcagcctggtggtcagcaccaagaaggtcccattcttcaaactctccgaggaatttgtggatcccaagtcacacaagtttgtcatgaggctgcagtctgagacctcagtgtgactgtgcaacagcagggggagtgggaaactctggggggtcctgagggggtgggagggggcttggttctcaggcccagccacattcctgccacccttcttcttcttgctcttttttttttacttgaattaacgcacccccaccttctctcctcgcttcttccttattttaccccatgtgaacctggagagaccatcctgctgtcaacagtacctgggaaggactcccacctcaccaacaacttttgtattactctaggccctgcaggaatcagtgcctctctccctcttctttccctagtcttttcccagattacagtctctcctgaaagggcacagggccctgctgattgtactttcccctcctgagccccgactcacaaatccaagttcttaaaacatttctcttcagtggcccaacagggtttctctggggcacatggacatgactccagagagccacagtgccaaactcctccagggcagcaactggccctcctgtccctcaccccagccacaacaaaccctgggttctagggcagggatactcctgccacacagcccgagttagaaatctccttgctaggagcatttgcttccacatatatttagagcaaagaaggatcccatccttttcccagaaatctccacctaatgtttttggtttgtatggtcacgtgaccataggcaaccacgtggaaaccctctgtgaccacttttccagggacttaggggaaggtacctttcttccaatgtgtcttcctaggcagcccctgaggaggagggctgaatagatccctgaggttttggagagacccccatcactgactcctgctccctaaccctaccctcactttcgtccccgctcttcccagtgaaggatggtatgtagactcctgtacagacatagtggcttgcagaccctgacccagcccctgtggtcttagacaaatgtttttatttttgtcaccagccacccctgtcctgccgccttctctcgactccagagacctgttgcctcatctcttttggggaagagccggcagctcctcctcatcccctgccttaagtccagttctttgcctcaggggtctcgtttccttggccttccagggtccccaccccttttctccctgcctgattctctgagctctgggctccgtctgtattgggttgaggggcaaggattactgccttttgtaggtacttcacccctcaccccattttagcttccatagtctttgcaccaaatccaaattcttgataatttagatctcattttgagcaaaatttgctggccctctaataaatattttcaatataaatctgagcctttgactcagacatttttgccaaggagagtagaattaggaagtacccatatacatccagccaggatccacatggaggacctttctgatggctgcaatgactaggccattcctctgagtaactcacagtgtccttttgtaggcccttcttttccctgaaagactggttggtacttaccttgcagagcacatcctgggataagatccccagtgtctcccctgggaggctccccctctgtgtagcaccagccctgggaatgatggagcctagtgatcggggtttctcctgctgtcctttctgcaaaagttcacttgtttacccaccgcatgctagagaggagctcattggccaatgcttaccttgtccccaaaggggtgggttgtggagctcacttaggcagggcctctggctggggccagggttatgagataggcctgtatgaaatatgtcctgttctgggggtctgtctcttttcttctcttcaaaaactttgtgtcagagagtcccttctgagtcacataaatacctcactatcctggaaaacagggcctggatggtgactggggtcattgcctttgtggacaggatggagtgtggtgtggtctgaggagcaggttggggtgggggagagggaaaggatttgggatcttagttgctgccctaggttaggggctggggagtgtttattttaagatcctgccatgtttttaatcactgtgatttttttttcattcccctttcctaaaaaaaattttttgcctccaactctctaagcactaagggctgtgcctgagaatggtagcattttggtcttttgcttcagaactgtggtatctttgtcttttttcattattattattattattattattattattactattgttttttaaaatgtcaggatgaattgtcagacatatggccatgtgtttgtcctctgcttctcccctgtgggaagttgtctccatgctgtgaactgctgtggggtgtgcagctgactcagtccctctgagcagtttccccactgtgtctgtcccatcatgcgctggatctgctcattctcctgctgtgggggtatgcccacctcttacccccttgacaccatagggctgctgtggctgggcctcaccagcactgtcttttgtgtgactcatggcatcctcgttcatccccaccgtgcctagcaggccttccttttcaccacctcggaacgcttgcctttcctccctccacaacaggacgctgtgcctcagtccttcacctacctcgccactctgccactgtccccattggtcctttctcctaaactggtctttgtgctctctttgttttttcttatttccctcttgtctctcattttttcttcccattcccctcccatttcagcccttaacttttctctttcccatctccactcagtattccaatggcaaaccctgatgatgtaacacctgcgatgagacatcggactctccggaactttctcatctgacacgtctttttcccagggttcgtacttctcctccattggtcccaggctaactcccctgttcctctgtggtgtctgtcagtccgtctgtcttctctttcctctgcccttcccacagggcagtatctgctgatggattcagtcctggtgtgtgattgttgtgatttgttcttccgtgcgcaaaaggaagagggctttttgagtcccttccaagtgagattgtaaatgtagaattttccactgttggatctagattttttttccttttttttgggggggtggggttacagagctgagaccttgtgcatgcatgtagaaaattgtaaaatgtaaattttttttaatatataaaaagcttgtttctacagtttgcagtggatctaaacattacggcaattttaggatttttttcttaaacataggaactaaaactgtacaaattttttttatataaaataaagacatttgacttttgtgggggca

SEQ ID NO: 34117 - DNA, 3106 bp, Homo sapiens
cattggacttcagcatgactactcagttgccagcttacgtggcaattttgcttttctatgtctcaagagccagctgccaggacactttcactgcagctgtttatgagcatgcagcgatattgcccaatgccaccctaacaccagtgtctcgtgaggaggctttggcattaatgaatcggaatctggacattttggaaggagcgatcacatcagcagcagatcagggtgcgcatattattgtgactccagaagatgctatttatggctggaacttcaacagggactctctctacccatatttggaggacatcccagaccctgaagtaaactggatcccctgtaataatcgtaacagatttggccagaccccagtacaagaaagactcagctgcctggccaagaacaactctatctatgttgtggcaaatattggggacaagaagccatgcgataccagtgatcctcagtgtccccctgatggccgttaccaatacaacactgatgtggtatttgattctcaaggaaaactggtggcacgctaccataagcaaaaccttttcatgggtgaaaatcaattcaatgtacccaaggagcctgagattgtgactttcaataccacctttggaagttttggcattttcacatgctttgatatactcttccatgatcctgctgttaccttggtgaaagatttccacgtggacaccatagtattcccaacagcttggatgaatgttttgccacatttgtcagctgttgaattccactcagcttgggctatgggcatgagggtcaatttccttgcatccaacatacattacccctcaaagaaaatgacaggaagtggcatctatgcacccaattcttcaagagcatttcattatgatatgaagacagaagagggaaaactcctcctctcgcaactggattcccacccatcccattctgcagtggtgaactggacttcctatgccagcagtatagaagcgctctcatcaggaaacaaggaatttaaaggcactgtctttttcgatgaattcacttttgtgaagctcacaggagttgcaggaaattatacagtttgtcagaaagatctctgctgtcatttaagctacaaaatgtctgagaacataccaaatgaagtgtacgctctaggggcatttgacggactgcacactgtggaagggcgctattatctacagatttgtaccctgttgaaatgtaaaacgactaatttaaacacttgcggtgactcagctgaaacagcttctaccaggtttgaaatgttctccctcagtggcactttcggaacccagtatgtctttcctgaggtgttgctgagtgaaaatcagcttgcacctggagaatttcaggtgtcaactgacggacgcttgtttagtctgaagccaacatccggacctgtcttaacagtaactctgtttgggaggttgtatgagaaggactgggcatcaaatgcttcatcaggcctcacagcacaagcaagaataataatgctaatagttatagcacctattgtatgctcattaagttggtagaatattgactttttctcttttttatttgggataatttaaaaaatgatggatgagaaaagaaagattggtccgggttaatattatcctctagtataagtgaattactagtttctctttatttagacaaacacacacacaccagataatataaacttaataaattatctgttaatgtagattttatttaaaaaactatatttgaacattggtctttcttggacgtgagctaattatatcaaataagtatcacaaatcttttacgcagaagaaataaaaactacgggtagaaaacataagaactatcataaaatttacttacaaggaggctgctcttgttaccacttttattatattacgtatcacttattcagctctgctgaaaatttccaatgactttgtttgtttgctctttttgttttttacctaaacaatacattttgattctcttgtgggttgataatgtctccccaaaatttacatgttgaagcacctcagaatgtgactgtatttggagacagggtctttaaagaggtaaaataaggtcattaggatagaccctaattcaatatgactgatgatcataaaagaagaggcgagtagggcacaacaggcacaaagggagaccataaggagacacagaggaaggacaactctttacaagctaagaagagagggcctcagaagaaaccaaccctgccaacaccttgatcttggacttccagcctccaaaactatgagaaataaatttctattgtttaagtcacccagtccatggtactttgttaggcagccctggcaaatgaatcaaagacccattcctgttcctctccccaccactactgttttctactgtaatctgaagcttcaacaaaaggcttacctggtaagaatattcagctggtctgggtcctcaagactccaatagacactcttagagaaggattgctgatggattgatagtgaaaccattagatcattgaattcctctggaattagaaaaccagagagtcccattttaagaaattagatatttaatatagcattgtgtgttctattttagtaacagcagaatctcttgacattacacaactcagtgaaacaacatcatttaagccaaaatatctcccaactgactgatagactctgagcactaatatcatagtgctgtgatgatggacaattacatagtaccgataacagccatgcactgtgcaaagcatgcccttctgcacaggagagcaaggcacttgcagtagtgatctatgccagcaaaacatcattttgagacaaacatttttgtggcagatgtttttcctaaaaagtactatatcatccaagaaatatttgagtaaaatcccttgttcttttgggtgacattaactgacatttgctttttttcaagacctaatagaaaataagaaagcccataatgtatttagaaacaggaatcctcagagcaattctctgtattctcatataatttcaatgtaaaacagaaaacatattgatgtgttggtgataggcttgaattattaaaaacttcaaaaaca

SEQ ID NO: 34118 - DNA, 2118 bp, Homo sapiens
aagaagaaaaatgatgataaagtaaaaggccagtaactggcagccacatgttatgcaaacattctcccctctgtaaatactacatgaatgttatttttgctttcagaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacactgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttgcttgagactttgtgtgtatgggggacttgtatgtatgggagtgaggagtttcagggccattgcaaacatagctgtgcccttgaagagaatagtaatgatgggaatttagaggtttatgactgaattccctttgacattaaagactatttgaattca

SEQ ID NO: 34119 - DNA, 594 bp, Homo sapiens
gactggaggagcacaggccttggaaaggaaagcagctgagatccagaggagtggaaggctcccccttgactaaagctaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtg

SEQ ID NO: 34120 - DNA, 1608 bp, Homo sapiens
acaggccttggaaaggaaagcagctgagatccagaggagtggaaggctcccccttgactaaagctaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacactgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtata

SEQ ID NO: 34121 - DNA, 587 bp, Homo sapiens
ggaggagcacaggccttggaaaggaaagcagctgagatccagaggagtggaaggctcccccttgactaaagctccaaggacagagaaaaacatccagatttgggaacacaataacagatatgattgtccccacttctactgccaaaattataaaactgttaactcctcctcatcagcttacctgactacttaaaagcaaaagagttaattaagtattactaattggtgatactagatcaatgaagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctccta

SEQ ID NO: 34122 - DNA, 543 bp, Homo sapiens
aaagcagctgagatccagaggagtggaaggctcccccttgactaaagctccaaggacagagaaaaacatccagatttgggaacacaataacagatatgattgtccccacttctactgccaaaattataaaactgttaactcctcctcatcagcttacctgactacttaaaagcaaaagagttaattaagtattactaattggtgatactagatcaatgaagaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatccca

SEQ ID NO: 34123 - DNA, 1713 bp, Homo sapiens
aatgtaaagtttttccagtgaaacaaaacgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagattcggcaacacaccagtgcaacaaagactcagctgcctggccaaggacaactctatctatgtcgtggctaatattggggacaagaagccatgcaatgccagtgactctcagtgtccccctgatggccgttaccaatacaacactgatgtggtgtttgattctcagggaaaactgttggcacgctaccataagtacaatctttttgcacctgaaattcagtttgatttccccaaggattcagaacttgtgacttttgacactccctttgggaagtttggcatttttacttgctttgacattttttctcatgacccagctgtggtggtggtggatgagtcaattgacagcattctctaccccacagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtgatctcctttagcagagcccttttaggattagcctggctaagaaaggaagaaaaaaaagagatccgttagtgtctgtttagaaaagatgttataaacttacagaaacaaatataataaactgaagcagatttgaaaagc

SEQ ID NO: 34124 - DNA, 1720 bp, Homo sapiens
aatgtaaagtttttccagtgaaacaaaacgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagattcggcaacacaccagtgcaacaaagactcagctgcctggccaaggacaactctatctatgtcgtggctaatattggggacaagaagccatgcaatgccagtgactctcagtgtccccctgatggccgttaccaatacaacactgatgtggtgtttgattctcagggaaaactgttggcacgctaccataagtacaatctttttgcacctgaaattcagtttgatttccccaaggattcagaacttgtgacttttgacactccctttgggaagtttggcatttttacttgctttgacattttttctcatgacccagctgtggtggtggtggatgagtttcaattgacagcattctctaccccacagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtgatctcctttagcagagcccttttaggattagcctggctaagaaaggaagaaaaaaaagagatccgttagtgtctgtttagaaaagatgttataaacttacagaaacaaatataataaactgaagcagatttgaaaagcaacaa

SEQ ID NO: 34125 - DNA, 517 bp, Homo sapiens
aatgtaaagtttttccagtgaaacaaaacgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggaggaagagtaaaaagatgaatgagcctgtttccaaagagctttgctatcactgtcattcagaatgcaatcaatatggccaatggaaattgtataggacttga

SEQ ID NO: 34126 - DNA, 1214 bp, Homo sapiens
atgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagattcggcaacacaccagtgcaacaaagactcagctgcctggccaaggacaactctatctatgtcgtggctaatattggggacaagaagccatgcaatgccagtgactctcagtgtccccctgatggccgttaccaatacaacactgatgtggtgtttgattctcagggaaaactgttggcacgctaccataagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtga

SEQ ID NO: 34127 - DNA, 780 bp, Homo sapiens
atgtggacactgggagaaggaagtgagatggaaaagttctttgattgcatccaagaagtgaatggtcctcaagggcgaccattggctgggtagtggagtgttgaccaatcacagctcaggggcgtgattgtctcgtcctgggatcgcgagaggggtatatacagggaggccaggcagcctggagttagccgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaaccactgagtcaggagagccaggtggaggaaccaccgagtcaggagagcgagatggaagaactaccgagtgtgtag

SEQ ID NO: 34128 - DNA, 967 bp, Homo sapiens
atgtggacactgggagaaggaagtgagatggaaaagttctttgattgcatccaagaagtgaatggtcctcaagggcgaccattggctgggtagtggagtgttgaccaatcacagctcaggggcgtgattgtctcgtcctgggatcgcgagaggggtatatacagggaggccaggcagcctggagttagccgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaaccactgagtcaggagagccaggtggaggaaccaccgagtcaggagagcgagatggaagaactaccgagtgtgtagacggccaagtactcccctatctccgagagcagcgactaagttcaggcccagccgccagacctcagagatctcaccagcggggtgcttgccattctgaagataataaaatgaatgtgttgcaaattga

SEQ ID NO: 34129 - DNA, 811 bp, Homo sapiens
atgtggatgctgggagaagtatgtgagatggaaaagttgtttcatggcatccaagaagtgaatgatcctcaaggtgtagcagaggaatttgtaggagagagggatgattgacgtcttcgtatagccctccatccatcccagttagcatggagggattttagggctaccattggctgggtagtggagtgttgaccaatcacagctcaggggcgtgattgtctcgtcctgggatcgcgagaggggtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggagagcgaggtggaagaaccactgagtcaggagagcgaggtggaagaaccactgactgtgtggatggccagcttttcccctgtctccgagagcaccgactaagttcaggcccagccgccagacctcagagatctcaccagcggggtgcttgccattctgaagataataaaatgaatgtgttgcaaa

SEQ ID NO: 34130 - DNA, 995 bp, Homo sapiens
atgtggatgctgggagaagtatgtgagatggaaaagttgtttcatggcatccaagaagtgaatgatcctcaaggtgtagcagaggaatctgtaggagagagggatgattgacgtcttcgtatagccctccatccatcccagttagcatggagggattttagggctaccattggctgggtagtggagtgttgaccaatcacagctcaggggcgtgattgtctcgtcctgggatcgcgagaggggtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaactaccgagtgtgtagacggccagctactcccctatctccgagagcagcgactaagttcaggcccagccgccagacctcagagatctcaccagcggggtgcttgccattctgaagataataaaatgaatgtgttgcaaattga

SEQ ID NO: 34131 - DNA, 808 bp, Homo sapiens
atgtggatgctgggagaagtatgtgagatggaaaagttgtttcatggcatccaagaagtgaatgatcctcaaggtgtagcagaggaatctgtaggagagagggatgattgacgtcttcgtatagccctccatccatcccagttagcatggagggattttagggctaccattggctgggtagtggagtgttgaccaatcacagctcaggggcgtgattgtctcgtcctgggatcgcgagaggggtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaactaccgagtgtgtag

SEQ ID NO: 34132 - DNA, 682 bp, Homo sapiens
atgtggatgctgggagaagtatgtgagatggaaaagttgtttcatggcatccaagaagtgaatgatcctcaaggtgtagcagaggaatctgtaggagagagggatgattgacgtcttcgtatagccctccatccatcccagttagcatggagggattttagggctaccattggctgggtagtggagtgttgaccaatcacagctcaggggcgtgattgtctcgtcctgggatcgcgagaggggtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggaacggccagctactcccctatctccg

SEQ ID NO: 34133 - DNA, 550 bp, Homo sapiens
cgagaggggtatacacagggaggccaggcagcctggagttagtcgaccgttgcgagacgttgagctgcggcagatgagtccaaagccgagagcctcgggacctccggccaaggccaaggagacaggaaagaggaagtcctcctctcagccgagccccagtggcccgaagaagaagactaccaaggtggccgagaagggagaagcagttcgtggagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtaaggggcgcccatctactcccctatctccctgagcagcaactaagtttaggcccagctgccagacctcagagatctcaccagcagggtgcttcccatgttgatgacaataaaatgaatgtgttgcaaaccga

SEQ ID NO: 34134 - DNA, 3083 bp, Homo sapiens
ctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaa

SEQ ID NO: 34135 - DNA, 2812 bp, Homo sapiens
cgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaa

SEQ ID NO: 34136 - DNA, 2475 bp, Homo sapiens
ctggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctgga

SEQ ID NO: 34137 - DNA, 2317 bp, Homo sapiens
ctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaa

SEQ ID NO: 34138 - DNA, 4633 bp, Homo sapiens
gtggccgcgctcggcgctgccatgttgaggagccgccgctgccgttgccgccgccgccgccgccgctttgttgtcgcctcctccggctgaggaggctccccgagcggggggagtggggaggaggggggtcggccgccgcagccatggaggccaactggaccgcgttcctgttccaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgactttttaaaaaaaaaaaaaatttaaaaaaaatctacaaattgtgttttgctaagaaaagcctcaactgacagaggagaagtcaagtgtgtggacaggcaagctcctaataaacagagtccagtgggattcctatttaggagccaaggagtactttggaacagtacaaatatattgctttaaattggaagacgctggaggcactgggatgtgatatgcccctctctctcccaatcagagcctgttgatattacaacagggacagatgtgttagttgctcactagagtttatgtcttatattaaattgtatacagtttttattctaaccactaactaggtagtgtatgccccttcagaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatgtttttggtttttttcattttttaatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtagggaaagcccaagaatgaccttgctgaggcctggattgggaggcacagtggccacatttggaggaagttcacatttcctggcatgcagacccaaaactgggttctggctctgcctgctgggatctgttatctctggtgggctggcagtcataattcacaattcagacagcccaggcttcctccacagtggtccaaggagcagtcctcagtgggggcaggtgtgggccctacccctaagctagaatgtggttgtcagaaccctgaaagtattagttctaaaaaaaaaaagatatatactagaagtaattgttttatcaattcattgtataataaacaggagtgagacttcattgtatgacttcagttaaaatactattttgtatgcattctttattcacttaagaagcttgtctgcaataataaagccacgtcatgtcttcttttgggagggagagagtcgatggcaggagggggttttgggtgggccactgaaaaggggtaccgaataggttgtgtgatgaaattctgtgtcttggaactggaattgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgtatccgttcccctcctacggtgtgctcctgaatgaaggtttctatgtaagcagatgatgattttacctgtcaataccagcactgtattactaacatgcaaaatactgcagatttattttgaaaattaaagttaactggtcacaaatgt

SEQ ID NO: 34139 - DNA, 2321 bp, Homo sapiens
agcggggggagtggggaggaggggggtcggccgccgcagccatggaggccaactggaccgcgttcctgttccaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgacttttt

SEQ ID NO: 34140 - DNA, 2773 bp, Homo sapiens
ggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgg

SEQ ID NO: 34141 - DNA, 3161 bp, Homo sapiens
attttcccagcttactagtggaaaagcagcttctttcccacagttccagcaaaagccccagggctgatgctcattggcccaggttggggcatgtgaccattggcaagactcccattggccaggcctggggcaggtgctcactactggagccagagcggagtataagccctacccaatcactgaactacgtgggtcaagagtaaaggagctgtggcttccccccaatcagaagggcactggatgatggatgaactctgtgtggtgcgtcttcacactgacaccaggaggataaggaagtgactccctcagctgagtggctggcatgtgccaggctagagcagcttggctatggcagaacatccagccccaccgtgtggacggcagagatgaggaaactggtgtggggttgccggggccagcaaccacttttctaaagccaaagacgcagaaggtgctgccagtccaacgcttcctccatggaggccttcacccacccacacccatctaagagttcccaagacctgttttttctggctattcctagacagccatcacccccactcacatgtcttccacaagggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgg

SEQ ID NO: 34142 - DNA, 1393 bp, Homo sapiens
agctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgaggtgggctgtaaggcagccatggtctttttccaatattgtgtcatggctaacttcttctggctgctggtggagggcctctacctgtacaccctgcttgccgtctccttcttctctgagcggaagtacttctgggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctcc

SEQ ID NO: 34143 - DNA, 1502 bp, Homo sapiens
ctcttagctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcgg

SEQ ID NO: 34144 - DNA, 3944 bp, Homo sapiens
gtgcattgagcgcgctccagctgccgggacggagggggcggcccccgcgctcgggcgctcggctacagctgcggggcccgaggtctccgcgcactcgctcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttatacactgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttttgagacggagtctcgctctgtcgcccaggctggactgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagccagctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcccttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggtcggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacgtgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcagcaggtgtctttaactgtcattgtgtgtggaatgtcgcagactcctccacgtggcgggaatgagctgtgtaaatacttcaataaagcctgacttcacatctgca

SEQ ID NO: 34145 - DNA, 1491 bp, Homo sapiens
aaacttcactccccagggctcccatccctggtgacaaagatcacagcagctggcactgcagatgcctttgtgggaggcaccatctgatcatcccgccaaccctcctgcaaccctgcaaggacacaccagcctcccagggtgccaggaggagcctgccagagacccccagagcggcctgccccaaatcacctctgagagcagcagcttttctgaaggaagcctcccctcatggtcctcaggcccagcaggtgccaagctcaatgccagccacgagggcattggctcatcgagtgatgggaacggggacagcaaggcggccacagagagggtggtctcagccatggacacagtacggcggaagcatcccgagatcacgttttatattctggtgaaggccatttatacactgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctgg

SEQ ID NO: 34146 - DNA, 717 bp, Homo sapiens
ccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaaggccatacaaagggattcatcctcattcacgccggaggtttaaagaggatcctggacccacatacctacccattggctccatgaccagtgcttttataattacaaaatcattgagaaattaagtcacaggaagcctcgtgtgtggtatacactggtgataaagcaagtcccatgcagtctgagatggcaagggaccttctagggaaagggcagtgacccagaagcccgactgctcggctggctcccgcactccgtcctgtggtcagagtgtgtttcctcccctctgtgaacctggtctcctccccagtgtgaggacaggggctctcgccttcttcagggagttgctgggaggacaaaatggagtatatgtaaaagtcatttcctagataagggggagcatgtcgtaagagtctcttgaaatttaattgatgtttatgtcattgacattgaaataatgagaaaataaatccaaatccagagctcaaa

SEQ ID NO: 34147 - DNA, 2806 bp, Homo sapiens
gactccggagcccgagcccggggcgggtggacgcggactcgaacgcagttgcttcgggacccaggaccccctcgggcccgacccgccaggaaagactgaggccgcggcctgccccgcccggctccctgcgccgccgccgcctcccgggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacagccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagagccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccgtctcacctatcgcaacctatcgggccctgataagcggctggtgacgctgcgactgcctgcctcgctcgctgagtacacggtcacccagctgcggcccaacgccacttactccgtctgtgtcatgcctttggggcccgggcgggtgccggagggcgaggaggcctgcggggaggcccatacacccccagccgtccactccaaccacgccccagtcacccaggcccgcgagggcaacctgccgctcctcattgcgcccgccctggccgcggtgctcctggccgcgctggctgcggtgggggcagcctactgtgtgcggcgggggcgggccatggcagcagcggctcaggacaaagggcaggtggggccaggggctgggcccctggaactggagggagtgaaggtccccttggagccaggcccgaaggcaacagagggcggtggagaggccctgcccagcgggtctgagtgtgaggtgccactcatgggcttcccagggcctggcctccagtcacccctccacgcaaagccctacatctaagccagagagagacagggcagctggggccgggctctcagccagtgagatggccagccccctcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttataagagatcctttcccatttattctgggaagatgtttttcaaactcagagacaaggactttggtttttgtaagacaaacgatgatatgaaggccttttgtaagaaaaaataaaagatgaagtgtgttt

SEQ ID NO: 34148 - DNA, 2888 bp, Homo sapiens
actagctgtcgctccacaggcgagcagggcaggcgtgcgggcgggtgggtggtggaggctgcgagggtgcacggccggccctgggcaggcggtagccatggagctgtggcgccaatgcacccactggctcatccagtgccgggtgctgccgcccagccaccgcgtgacctgggatggggctcaggtgtgtgaactggcccaggccctccgggatggtgtccttctgtgtcagctgcttaacaacctgctaccccatgccatcaacctgcgtgaggtcaacctgcgcccccagatgtcccagttcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatgg

SEQ ID NO: 34149 - DNA, 2545 bp, Homo sapiens
ctaccccatgccatcaacctgcgtgaggtcaacctgcgcccccagatgtcccagttcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatgg

SEQ ID NO: 34150 - DNA, 2775 bp, Homo sapiens
aggcgagcagggcaggcgtgcgggcgggtgggtggtggaggctgcgagggtgcacggccggccctgggcaggcggtagccatggagctgtggcgccaatgcacccactggctcatccagtgccgggtgctgccgcccagccaccgcgtgacctgggatggggctcaggtgtgtgaactggcccaggccctccgggatggtgtccttctgtgtcagctgcttaacaacctgctaccccatgccatcaacctgcgtgaggtcaacctgcgcccccagatgtcccagttcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatgg

SEQ ID NO: 34151 - DNA, 2620 bp, Homo sapiens
acaggcgagcagggcaggcgtgcgggcgggtgggtggtggaggctgcgagggtgcacggccggccctgggcaggcggtagccatggagctgtggcgccaatgcacccactggctcatccagtgccgggtgctgccgcccagccaccgcgtgacctgggatggggctcaggtgtgtgaactggcccaggccctccgggatggtgtccttctgtgtcagctgcttaacaacctgctaccccatgccatcaacctgcgtgaggtcaacctgcgcccccagatgtcccagttcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcagccaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcaccctgcgggacctgctgatggtgcctatgcagcgagttctcaaatatcacctccttctccaggagctggtgaaacacacgcaggaggcgatggagaaggagaacctgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacattaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggttggctggttccctgccaactacgtggaggaagattattctgaatactgctga

SEQ ID NO: 34152 - DNA, 4820 bp, Homo sapiens
actttggctcgagcactgccctgagccggtcgggcccgcgggcgccatggagcagtggcggcagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcagaactagtggggacagggacgcctccggagcgggaccaggtcccaagatggtggccatgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagcttcctgtgcttcctacaacttttcttttctcagtcctcagggcctcagctttgcttctcagggcccctccgctcccttctggtcagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctggactcagccttgcctgtcttttcctgctgctcccagggggaggtgtcagacctcgggaggcagacgggaccagagccaggctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgc

SEQ ID NO: 34153 - DNA, 4837 bp, Homo sapiens
actgccctgagccggtcgggcccgcgggcgccatggagcagtggcggcagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgattagatacatgcagaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtctcacgggaaaatgtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttctcctgcagatctggacgcctccggagcgggaccaggtcccaagatggtggccatgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagcttcctgtgcttcctacaacttttcttttctcagtcctcagggcctcagctttgcttctcagggcccctccgctcccttctggtcagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctggactcagccttgcctgtcttttcctgctgctcccagggggaggtgtcagacctcgggaggcagacgggaccagagccaggctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgca

SEQ ID NO: 34154 - DNA, 5101 bp, Homo sapiens
cgcggattggggagcgctgcggcgactggctgcgtggagcccggcccggggcccgcaggcacttgcgtgtgtgaagcggggagatccggcgcgctgcccgttgcccgccccgcggccgcacgtgggcgggagcggcggcccgagaggagcccgaggagtaggaggaggaagaggaggggacgcacggcggcgcagcgggggacctggggcagcccgcgcgaagccccgccccggccctgagccccgcgcgcgcgcgggcgggatgccccgcggccgctgcactttggctcgagcactgccctgagccggtcgggcccgcgggcgccatggagcagtggcggcagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttctcctgcagatctggacgcctccggagcgggaccaggtcccaagatggtggccatgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagcttcctgtgcttcctacaacttttcttttctcagtcctcagggcctcagctttgcttctcagggcccctccgctcccttctggtcagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctggactcagccttgcctgtcttttcctgctgctcccagggggaggtgtcagacctcgggaggcagacgggaccagagccaggctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgca

SEQ ID NO: 34155 - DNA, 4691 bp, Homo sapiens
gccatggagcagtggcggcagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttctcctgcagatctggacgcctccggagcgggaccaggtcccaagatggtggccatgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctggactcagccttgcctgtcttttcctgctgctcccagggggaggtgtcagacctcgggaggcagacgggaccagagccaggctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgca

SEQ ID NO: 34156 - DNA, 4990 bp, Homo sapiens
gcggcagccgccgccgagccggccggggcgcacggagagcgcgcgggactcgctgcagcggcggccgggtcgcggcgcacccgggccgggaccggagccgagcctagcgcggcgcccgcgacccgtcagccgcggctcctgctccctcgatcccgcgcggggaaagggccggcggctgttggcgtcggcggggcgcggaggaaccgcggcggcggcggcggcggccgcatccttgccgcccgccccggcccagccgcgtcccggagccgtcgggcatggagccgtggaagcagtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccagtttctctgtttgaagaacataaggacatttctcacggcctgttgtgagacgtttggaatgaggaaaagtgaacttttcgaggcatttgacttgtttgatgttcgtgactttggaaaggttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaagtatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagacaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggaaagatccagccttacttgtcttaaattgtccaacaaggtgactcattgcccggcaaacacttttaccctcagatgttactcatgatattataaaatatgaggccagtgctcaggtttgcatcataagtgagctatccctgaagggttttaattacttatttggtgtcctgattatatttgcaaacttctttataaaaggtgaaaaaagcacacaaaagagagggtgtcttcatattaaaccttcacaaccttcatgatttcataggattattttggaaatatagcacttgactttatgaaaggatctgggctaggtatattaagggtagttgccaataacctgaagaagctggcattgtttacagaaacagatcaagggctataatttatgtcattttatagcagcagtatctattaatacatgccttttcctcccatccacctcccccgcacacacacaaagatgacctgggacatgatttttttattcccacattttcttggagcacaaacaactttgttgaggattttggaaggaaagcacaactgggtcctttattcatttctgggacagaaagagggtcagtggacttttgtgggcctccagcttctctcagagtctccccctctgcagcccatcctgggagtgtattaactggagggaagatgggtcttgcagtacatttgttttgcccagccatcactcttttttgtgaggagcctaaatacattcttcctggggtccagagtccccattcaaggcagtcaagttaagacactaacttggccctttcctgatggaaatatttcctccatagcagaagttgtgttctgacaagactgagagagttacatgttgggaaaaaaaagaagcattaacttagtagaactgaaccaggagcattaagttctgaaattttgaatcatctctgaaatgaagcaggtgtagcctgccctctcatcaatccgtctgggtgccagaactcaaggttcagtggacacatccccctgttagagaccctcatgggctaggacttttcatctaggatagattcaagacctttacctcagaattatgtaaactgtgattgtgttttagaaaaattattatttgctaaaaccatttaagtctttgtatatgtgtaaatgatcacaaaaatgtattttataaaatgttctgtacaataaagttacacctcaaagtgtactcttggaatggattctttcctgtaaagtcttatctgcgactctgtctcgggaatgttttgtctgttgccgtcagccgaactttgttatggagggagcagcctcacacaagcagaaacactcctgtggatggtattgtagcatgtattgtttattttagtcaatagaccctctccttataaatggtgtttagtcttcctgttgcatttcatgggcctgggggtttcctagcagaggatattggagcccctttttgtgacattaccaattacatctttgtccacgtttaatactttgttttggaaaatttaaatgctgcagatttgtgtagagttctaataccaaagacagaagtaaatgttttccatatactttgtcttgcctgtatgcagccctcgtgtaatacggtgaattagagtggtatttcactttgtattattttgtaaatatgtcaatataataaatagtgactaaattgat

SEQ ID NO: 34157 - DNA, 2271 bp, Homo sapiens
agtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccagtttctctgtttgaagaacataaggacatttctcacggcctgttgtgagacgtttggaatgaggaaaagtgaacttttcgaggcatttgacttgtttgatgttcgtgactttggaaaggttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaagtatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagacaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccagatgtgccctgtctccttcatttctttatttccatggcccctgctactagaagcattgtaaaaagccaaaagaagaacaagaaattctgaggacatgggtgaaaatgcagccttgaggtttctgaaaataacaggagacagacaaggctggtgtccagcaacaatactgggtagctctttttgtccccacttacacagcgaaggataaagaagagatcctatggacacttagtaaggattacttcatgttttaattcaaagtactttggaaagaagactttgagcagagtggaatagcaggaggtttttgtaaggtgaaatagaatgaaagtgcagccaagaatttttctgtcttcaattttaaagaacaccggcataactcatttttctttttttcccctgtgttctttttgaccttcttagcagctcctgactttctcccttggggatttttctctgtatagtcagcgctgactcccttagaaatcctgaaccccacacccgtatcgcg

SEQ ID NO: 34158 - DNA, 1293 bp, Homo sapiens
aaagcagtggtgttttaccactctgcagagaaagctaaggttgctaaccaaacaaaataactttacactgacaatgccaatttttacatttctttcagaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatctta

SEQ ID NO: 34159 - DNA, 4510 bp, Homo sapiens
ctcctgctccctcgatcccgcgcggggaaagggccggcggctgttggcgtcggcggggcgcggaggaaccgcggcggcggcggcggcggccgcatccttgccgcccgccccggcccagccgcgtcccggagccgtcgggcatggagccgtggaagcagtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccagtttctctgtttgaagaacataaggacatttctcacggcctgttgtgagacgtttggaatgaggaaaagtgaacttttcgaggcatttgacttgtttgatgttcgtgactttggaaaggttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaagtatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagacaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagctccccctctttgttctgtggcttttcttttgtaactcctccagactacagctttgttcccccttcttccactcctttctggtcagtgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggaaagatccagccttacttgtcttaaattgtccaacaaggtgactcattgcccggcaaacacttttaccctcagatgttactcatgatattataaaatatgaggccagtgctcaggtttgcatcataagtgagctatccctgaagggttttaattacttatttggtgtcctgattatatttgcaaacttctttataaaaggtgaaaaaagcacacaaaagagagggtgtcttcatattaaaccttcacaaccttcatgatttcataggattattttggaaatatagcacttgactttatgaaaggatctgggctaggtatattaagggtagttgccaataacctgaagaagctggcattgtttacagaaacagatcaagggctataatttatgtcattttatagcagcagtatctattaatacatgccttttcctcccatccacctcccccgcacacacacaaagatgacctgggacatgatttttttattcccacattttcttggagcacaaacaactttgttgaggattttggaaggaaagcacaactgggtcctttattcatttctgggacagaaagagggtcagtggacttttgtgggcctccagcttctctcagagtctccccctctgcagcccatcctgggagtgtattaactggagggaagatgggtcttgcagtacatttgttttgcccagccatcactcttttttgtgaggagcctaaatacattcttcctggggtccagagtccccattcaaggcagtcaagttaagacactaacttggccctttcctgatggaaatatttcctccatagcagaagttgtgttctgacaagactgagagagttacatgttgggaaaaaaaagaagcattaacttagtagaactgaaccaggagcattaagttctgaaattttgaatcatctctgaaatgaagcaggtgtagcctgccctctcatcaatccgtctgggtgccagaactcaaggttcagtggacacatccccctgttagagaccctcatgggctaggacttttcatctaggatagattcaagacctttacctcagaattatgtaaactgtgattgtgttttagaaaaattattatttgctaaaaccatttaagtctttgtatatgtgtaaatgatcacaaaaatgtattttataaaatgttctgtacaataaagttacacctcaaagtgtactcttggaatggattctttcctgtaaagtcttatctgcgactctgtctcg

SEQ ID NO: 34160 - DNA, 1374 bp, Homo sapiens
aaagcagtggtgttttaccactctgcagagaaagctaaggttgctaaccaaacaaaataactttacactgacaatgccaatttttacatttctttcagaacaagggacactcaaactaccagaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactg

SEQ ID NO: 34161 - DNA, 5325 bp, Homo sapiens
cggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacatggaaagggtcttccttctcattgctgcccgtttgtacatgggactgattctgttgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggcttttttttttcttttgttttggtttggttttggaaaactaattaattagacttgtgtgggggtttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagtagctgggactgcaggcgcgcacaccacgcccagctaatttttgtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccaacagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatatgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgactggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagc

SEQ ID NO: 34162 - DNA, 2037 bp, Homo sapiens
gaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcatagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggca

SEQ ID NO: 34163 - DNA, 1147 bp, Homo sapiens
ccgccgtagaggggttggcagtggcggtcagcatgggcgatgggggcgccgagcgcgaccggggccccgcgcgccgggcggagtctggtggcggcggtgggcgctgcggagaccgcagcggagcgggggacttgcgagctgatggcggtggccacagcccaacggaggtggccgggacctcagcctccagtcccgcaggctccagggagagtggagccgacagcgacgggcagcccgggcccggcgaggcagaccactgccgccgcatactggtgcgagatgccaaagggacaattcgggaaattgtcctgcctaagggcctggacctggaccggcccaagcggacacgtacatccttcactgccgagcagctgtaccgcctggagatggagttccagcgctgccagtatgtggtgggccgcgagcgcactgagctggcccgccagctgaacctctccgagacccaggtgaaggtctggttccagaaccgccgcaccaagcagaagaaagaccagagcagagacctggagaagcgggcgtcctcctcagcctccgaggcctttgccacctccaacattctgcggctgctggagcagggccggctgctctctgtgcccagggcccctagcctcctggcgctgacccctagcctgccaggcctacctgccagccacaggggcacctccttaggtgaccccaggaactcctccccacgcctcaacccgctgtcctcggcctcagcgtcccccccactgccgccccctctgccagctgtctgcttttcctcggccccgctcctggatctgcctgccggctacgaactgggttcctcggccttcgagccatacagctggctagaacggaaagtgggcagcgccagcagctgcaagaaagctaacacttaagactcccaccctgtgacactgagtcccgagcacagcaccttcccagtctcctgtgccccagcggacagcactgagcaggccccggagaggaggggctgcagccacacactcttccccacctgccccccagctcagagactcgtgaccaaatggccttggtcccgcagcttgtgtgcgtgagtgcagtgtgagtgtgtgtgtctctcactgaaataaaaggaaaacaatgacaagaagggaaa

SEQ ID NO: 34164 - DNA, 4202 bp, Homo sapiens
ggcagctcagggagacgcggctgcagcccacaggactgggcagcagctgcaaggctgcctctgagcatggtcatgggtcccagctgcagtgctctaaagatcaaggattttgccttctattttctatgaccagagattcctgtgcaaagagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcagagcctgtttcctgaacccctgtccattcagagtcattctgtgcaattcctcagagctctgtgggagaagacccaggcagggggtgctcacagctttgaaactgccatgatggagtccacgtttccacagcagaaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaa

SEQ ID NO: 34165 - DNA, 3044 bp, Homo sapiens
attcttccacccggcaccggctccgcaatgaacaacttcaggttcactgagctgagcggattccactcgctgtgccctcggagcctgcctgaatctcccgcccagtctcaaaccatgcagctgagtaactgcaagggcgcctttgaggagtagcacgcagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcagagcctgtttcctgaacccctgtccattcagagtcattctgtgcaattcctcagagctctgtgggagaagacccaggcagggggtgctcacagctttgaaactgccatgatggagtccacgtttccacagcagaaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaat

SEQ ID NO: 34166 - DNA, 3979 bp, Homo sapiens
gtgctctaaagatcaaggattttgccttctattttctatgaccagagattcctgtgcaaagagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaa

SEQ ID NO: 34167 - DNA, 730 bp, Homo sapiens
tggatgcaattgtttaggagaagagtgaaggagaagagaagagagcccgaaactaaacagggaggaatccaccatttagaagtctggcaggcaaagaggacaaggctttgtgtttcacctcaggaaacagagcgttgcactgggaggtaactccgctgggtgaggtgcagcctgtcacctgaccggtctctggggctgccggtggcatcaggctgcattccttgaattcttccacccggcaccggctccgcaatgaacaacttcaggttcactgagctgagcggattccactcgctgtgccctcggagcctgcctgaatctcccgcccagtctcaaaccatgcagctgagtaactgcaagggcgcctttgaggagtagcacgcagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcac

SEQ ID NO: 34168 - DNA, 1401 bp, Homo sapiens
ggttgttaggcaaatctaattctttcaaactacagatctgctcagagaaatctgtaaatctagtgtagaaataagtgaagctttgcgtcaattgttaggtctaagcagaagtttgggagagagaagaaaagttactcatttgcctgattccgcacgagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtatggtgcgaaagttgagcttggggacatgttttgggagatatttaaaagtattttcatcaagcatttatggtttgtgggaagcaagacctagagtattagaagcaaattaatttctctgttttgctgccagttgacctgtgaacatgcaaaaggttacttaatctggctgtctgtgtcccttcccaaggcagatgaattacttagactcattaaaagaattgtaagcattcttccaaatctgtgtttctcagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaa

SEQ ID NO: 34169 - DNA, 746 bp, Homo sapiens
tgtttaggagaagagtgaaggagaagagaagagagcccgaaactaaacagggaggaatccaccatttagaagtctggcaggcaaagaggacaagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgat

SEQ ID NO: 34170 - DNA, 557 bp, Homo sapiens
gatgcaattgtttaggagaagagtgaaggagaagagaagagagcccgaaactaaacagggaggaatccaccatttagaagtctggcaggcaaagaggacaaggtgtaatatctggttgctgttgccattctgccaccaagaaacctgatgacttcatttgggcctcttcaaccagctgcccctaaagctagcaagctccacccttcagtgtccactgataaattccttaatagcagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccagg

SEQ ID NO: 34171 - DNA, 1714 bp, Homo sapiens
tgtaaatctagtgtagaaataagtgaagctttgcgtcaattgttaggtctaagcagaagtttgggagagagaagaaaagttactcatttgcctgattccgcacggaaacagagcgttgcactgggaggtaactccgctgggtgaggtgcagcctgtcacctgaccggtctctggggctgccggtggcatcaggctgcattccttgaattcttccacccggcaccggctccgcaatgaacaacttcaggttcactgagctgagcggattccactcgctgtgccctcggagcctgcctgaatctcccgcccagtctcaaaccatgcagctgagtaactgcaagggcgcctttgaggagtagcacgcagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtatggtgcgaaagttgagcttggggacatgttttgggagatatttaaaagtattttcatcaagcatttatggtttgtgggaagcaagacctagagtattagaagcaaattaatttctctgttttgctgccagttgacctgtgaacatgcaaaaggttacttaatctggctgtctgtgtcccttcccaaggcagatgaattacttagactcattaaaagaattgtaagcattcttccaaatctgtgtttctcagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaatattctccttgtcttcttttattttctttggtttcagatcaatcaaaaaacatgtttttgaacttgaagtcagagaacaatacatgatattaattgatgtgca

SEQ ID NO: 34172 - DNA, 992 bp, Homo sapiens
agagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaat

SEQ ID NO: 34173 - DNA, 4178 bp, Homo sapiens
gaaacagagcgttgcactgggaggtaactccgctgggtgaggtgcagcctgtcacctgaccggtctctggggctgccggtggcatcaggctgcattccttgaattcttccacccggcaccggctccgcaatgaacaacttcaggttcactgagctgagcggattccactcgctgtgccctcggagcctgcctgaatctcccgcccagtctcaaaccatgcagctgagtaactgcaagggcgcctttgaggagtagcacgcagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaa

SEQ ID NO: 34174 - DNA, 4624 bp, Homo sapiens
ggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagcta

SEQ ID NO: 34175 - DNA, 4806 bp, Homo sapiens
gttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagcta

SEQ ID NO: 34176 - DNA, 3238 bp, Homo sapiens
gcgcttgctcccaatcacaggagaaggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgt

SEQ ID NO: 34177 - DNA, 2147 bp, Homo sapiens
gaatgcacagggtgggcctagtcagaagaagcctttcccctgaaatccctctacttcccaagcacgcaagctttctcctgctgttaaacctgcagtgtgcaagggacatgggcggaggggtccttcagtcaggcttctccctgtctgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcgtgagtccaacggtcttttctgcagaaaggaggactttcctttcaggggtctttctggggctcttactataaaaggggaccaactctccctttgtcatatcttgtttctgatgacaaaaataacacattgttaaaattgtaaaattaaaacatgaaatataaattaatgccct

SEQ ID NO: 34178 - DNA, 4624 bp, Homo sapiens; identical to SEQ ID NO: 34174

SEQ ID NO: 34179 - DNA, 4341 bp, Homo sapiens
atgccccgggggtcctggaagccacaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagcta

SEQ ID NO: 34180 - DNA, 2905 bp, Homo sapiens
cggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtactgcaactactgtgacttacagtgagacaaaagatacgaacacaacagaaatttcagcaactagtggactagttcctggagggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaa

SEQ ID NO: 34181 - DNA, 736 bp, Homo sapiens
ggtggctgggtgggtggggaggagactgtgcaagttgtaggggagggggtgccctcttcttccccgctcccttcccccgccaactccttcccctccttctccccctttcccctccccgcccccaccttcttcctcctttcggaaggactggtaacttgtcgtgcggagcgaacggcggcggcggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccgcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatga

SEQ ID NO: 34182 - DNA, 3240 bp, Homo sapiens
cttcttcctcctttcggaaggactggtaacttgtcgtgcggagcgaacggcggcggcggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccatatgagaacatgccgcatacatgaaatcagctgtggcgcccattctactcagtgtatcccagtgtcctggagatgtgatggtgaaaatgattgtgacagtggagaagatgaagaaaactgtggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaaggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaa

SEQ ID NO: 34183 - DNA, 3590 bp, Homo sapiens
ctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccctcttcttccccgctcccttcccccgccaactccttcccctccttctccccctttcccctccccgcccccaccttcttcctcctttcggaaggactggtaacttgtcgtgcggagcgaacggcggcggcggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccatatgagaacatgccgcatacatgaaatcagctgtggcgcccattctactcagtgtatcccagtgtcctggagatgtgatggtgaaaatgattgtgacagtggagaagatgaagaaaactgtggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtactgcaactactgtgacttacagtgagacaaaagatacgaacacaacagaaatttcagcaactagtggactagttcctggagggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaa

SEQ ID NO: 34184 - DNA, 787 bp, Homo sapiens
gccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgccgtacagtggagaatgtgacagtgttcggaacggcctcggccagcaagcacgaggcactgaaggagaatggggtcacacatcccatcgactatcacacgactga

SEQ ID NO: 34185 - DNA, 2758 bp, Homo sapiens
ctcgcccggcgccccgcccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaaggtctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaaccctggg

SEQ ID NO: 34186 - DNA, 1007 bp, Homo sapiens
tcctggtgtctgggttggggaggggtcatggccctgatttggatggcctgagggttagcatgagccagggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaaggtctctgtggtgatgaccgctct

SEQ ID NO: 34187 - DNA, 2583 bp, Homo sapiens
actctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaaggtctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaaccctg

SEQ ID NO: 34188 - DNA, 4131 bp, Homo sapiens
ccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgatgaaaagaaacagatggttgcaaatgtggagaaacagcttgaagaagcgaaagaactgcttgaacagatggatttggaagtccgagagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaagaatcatccagaaccgcatcctgctcgtcatcctagggatcatcgtggtcatcaccatcctgatggcgatcactttttctgtcagaagacactgatgtatctgctctcccttgataaacagcaacaacagcttgttctgagtaattaagacaaaatggtcacatgaatcattctgttgcgctgacaggccccaggtgaccctctctctccctcaccgccgttgggctgaagtgcaaagagtgtaaaaatattttctattcctgtttgcatgtgggttggtttccttttcgaggtttgtcttcacccagattcgttttttagaggggaaggtgaatgtttatttacctttttgctaatgtcatcaactagccaaaatagccccagtgacactcctagccctctggacgtgtcaagggccgtggtttgggagaggacatgatgagtcagtcacgagagcttctgtttgtcacccgcctcttgttgctgaaaagctcttctgtgatgtctgaggataaaaatgcagcaaaaagcaggggatggagtcagtgaccccgtccagcaagccagccctgttcctacacaggcctcatgaatatagtcatcaacctgcctgagtgctttcattgtaaaggtcggtatttaatgtcggttgtacaggaaattgacttagcactttccctgtttttctattgcataattttttttttaacccaaagatattttttttgctgagcctgcccagtattcactgttcacaactttgattactggctacaagaaatattttcttgccttccccaaatcccatactccccagaatctgctggcaaagtgagccctggtacaggatttaattgtgacctcgtcttccctgacctgtgtaagcatctctgtatcctttcggttttaatatctgcactgccaaaagcagtcctcatacttgcaaaaggtctgacaaggttctctccacatacattccagtatgtaaagagaccatgaatatttcagtaagagcaagaacatgactccatcagtgtgaaatttcaaatgtgattataaatatgggagagtcctataggagggtccaccagagataaacttcacggaaaacgttccctaacctcctttaaaagaatagaggatggcagattgttccaaaaggaatggcttgggtttttaactaacaaatgttagcaagcctttcttgaattcactatgtattcaaacttctaatatgctttgtgatttttttctttcatttctttctgtctgaggtaaccaggaattgcgttcaaaatgagctcatttgtgatcaggcttaaaagttgcccaagctgaggtcgtttccccccagtcacaaagcagaatgtttttctcaagacttcataggcacttactggtccgtactatctttggaatataattagaagctttgaatccttgaaaagcaaacctgttctcttcatcaaaaatgctaaccacctgtgcccgtggatcaatatcacctggatgtagtgcttgatatttttcccaactcagaagaaaaccattatggtttagagaggaaatgcagaatggcagaatccaccagagaaattgcacttatcgaaacaggccaaggcctgcatgtgttcggataaatcatttagtattgtgtaaataaagctgcagcctttacttcggagggatggtgtgggattttggccgagggaagcaggacagagaaggagcaggaagctatgctaattttcctgtcagcttaagggatccgtctcagcaagaatcttgtattctgataacggaatgctgtacgtgctgaccacatctaagaaccattaaaaagcaaggaaacaaacaaacaacccttttctcattccgacacacgaatagtcatcgagtattacaccagcccctctggtggcttccttcaaaactgttgatcttagctaaagtgtataaccagttaccagctgcacttcgcacggccatcccgtccacaatgcagcagactcttcccaaggccacctagcaagcaaggttgatcggatcatctaaactggccgcctcctgaatatttcactgaatcctggcgttcatgttgaagcagacaaaatgagaaaggaggagggcattgctcacctctcaatagcttttttcgttcaagttctatgtctttatcagctcttgcctgtgattttaccccaattcaaccttgggagtgggaagaatatgaacagataacccttggcctaacagctccatcaaacctccttgagagcaactacctaggccaggctagtgagtgctttgtgaggaagctggtcagaaggttccctcaactccttcctggtcctcctggacactgcagaaaagacttaggggatccccagcagaggccaattgctctccttccttccctgccccaccaggaaaggaataacgtccacagacttgaagcagatagtgaagtagatctgtgagaggttctaggtacttagtgtgtagactttgacgaatatttctcaagttgggagcccttgttaaaaatgatgtttaagggagtggttggggggaagatgaaggcatggaggaggaagaagagaaggaagcccttgccatataaaattcatgcagactaaacagtttccctgacagaataaataaagtggatgctaccccactccagaatcaaaagcaatttaattaaagtctcttaagttgtaaagagttttaaatgatccgtgttgaaggcgaatgcctgcaaatgcagtgggtctgacgtcagctgccgggcctgggctgggaggccatttgctattctgtttaaggcaggctggattgtcttattttggaaccagcttggtggggggtttgctttgctactgcttctgagccctgagcttcaaaggctgaaattaatggtgaacaaaattgtgcggctctggccatcccatgcggggcaagcccattgagggttatcattaagtaaagaaataaagagggggaaaaaagcctgcctgttccaaaaacctcatcagataatgacctcagtgattgggttttcattaccaaacagcatccagagattatcaacccatagaagaagggaggggaaaaaaaagaaagaaaggaaaagcaactgtctttctctccctctctttctcctttttttttgcacatcttttctttaaaactgtcagatcatttcagtatttcaaatccgaggaaaacagcctgcctgctgctgtatttgaagttgtaatggtgtcaaaaagtcacgactgactgacagccgtcagtcccagaggggctcattaaatcataaaaacttgacaaggaaataattgcgcattgccagcaacttggcgcctgtttagacgtttttattttctttcattattagtccccaccattacgttcattaacaaattgcattaaacaactgttaagggctaa

SEQ ID NO: 34189 - DNA, 1738 bp, Homo sapiens
ccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgatgaaaagaaacagatggttgcaaatgtggagaaacagcttgaagaagcgaaagaactgcttgaacagatggatttggaagtccgagagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaaggggttgttctgtgaaaaaacaatgtaacctgtctctggccccaaaggcttgaaccagaaccagccagtggaaattactcaaacacgtattgtgccttcaatgagaagccttctcactgaaagagctgccctggacggaaaatgagtagtgagatgatgctggtggaagtatttatagatgcgcagtgcatgagtacttggcaaggatgctatcaaaggggaaactgacatcaaatgtgctgtggttctgggtgatttatctggtcccttcccatcccagagctttatgattctgtaataatcaagggagaaacccattacatagtggacaattttttttctttttttttctttttctttttttttttgagacagagtcttgccctgtcgcctggctggagtggagtggcacaatcttggctcactgcaacctccacctcccaggtccaagcgattctcttgcctcagcctcccaagtagctgggactacaggcacacaccaccacgcccagctaatttttgtatttctttttttttttttttgtagagatggagtttcaccatgttggccaggatggtctcgatctcttaaccttgtgagccaccgtgcccaaccctaacaattatttttaaaaggaggaatttaaatgagctgtggattattcattttgtcccataagaagataattaaaaaatgacaaaaatgaactgaacaaaaaagttctaacaaaataataaggctgaatttttaaagtctcttccgcatcttctgttccctgggatgccttagacggggtgtgcagtattttaggtacatcgtgagcaaggagcctgcattcccagggggcggcagggacagcatgtaaggtcttagtccagctctgtgatctgaaggcaaagcctctatgtgtgaaacacaggggtacctcaaaaatagaacaagagcactccatccatgtgcggatgactgtcaaggtcactgagacctacagtgatctggaaaattaaagctctctggccgcctttcctctcaggacatacttctggagatcaaaaaaaaaaa

SEQ ID NO: 34190 - DNA, 970 bp, Homo sapiens
agtaagttccagcgcagctagaccgcggggtagtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggaagatggcagctcactcagtactgcctggtcatgtggagctttccttcctggaccaggcctgaagagggtcctgggggtggaccaaagtccaacttggtttcagtgcagtacccttttcgaaagtaaaaacttgttttttgtagttatttctaatctgttcgtccaggattttccgtgtctttggggatcttacaactttactttgttctccagaggcctggagaacacttagggattgtgaaaatagcaggacttgtttccatcctagaagcagtcccatgtgcttctagctggaaggagctttctcttctttacattttctacagcattctgtatgagggcaccaaataaatccatctagctggtagttttatctagccaaataatttaacctagctcccagttaattgttggcataaagagagagattgcctgttagttatagagaaacagtgagtcaagtgcttaatttgaaagtaacaagctcagaggaagccactccttgccctcgttaaaga

SEQ ID NO: 34191 - DNA, 3449 bp, Homo sapiens
accacaaatgcctaacaaactgctgaagcgccctccgaagggacagacctcatctccaccccgccccgtccctccgccagactggagcgcaaactatggtcgcattgatcactgaaggatcctcacagcaaccgctcctttccggagtcggatgagaggagagttgtgactggcaattggcaggggcggggcgggctaggcctgtagcgctgggcgaccgtcctgggcatggattgggccgcggggttgtcaccgttatccgggaggcgtggtcagcactaataaaggcggaggccggcgcggcagctgcagtaagttccagcgcagctagaccgcggggtagtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaagtaagtatcgctgaagttgctggtggggtgaagaggtgggaaggtcctggagtcttctccctgcctgcctgcctgcctggggagtggggctgctctgactgaggtatggagaccgctgctatgggatcgtcacctggttcgggacgggggaagggcagagacaagggatttctttgatggacaagccttccccctgcaacgcattgcagggagatggcgcctcctgttctgaggaagtggggctatgctgtgtgtcactggcttgggttggagggagaccatggggatggggcacttaacaatggagagacctgaatgtctggtaacttggtgtaattcaccctcttgttttctcctgtctctttctcttttccgtctgggacttcctgattcctgtgtccagtctacttttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggccactggtaggagctagggaggggctgggaagatggcagctcactcagtactgcctggtcatgtggagctttccttcctggaccaggcctgaagagggtcctgggggtggaccaaagtccaacttggtttcagtgcagtacccttttcgaaagtaaaaacttgttttttgtagttatttctaatctgttcgtccaggattttccgtgtctttggggatcttacaactttactttgttctccagaggcctggagaacacttagggattgtgaaaatagcaggacttgtttccatcctagaagcagtcccatgtgcttctagctggaaggagctttctcttctttacattttctacagcattctgtatgagggcaccaaataaatccatctagctggtagttttatctagccaaataatttaacctagctcccagttaattgttggcataaagagagagattgcctgttagttatagagaaacagtgagtcaagtgcttaatttgaaagtaacaagctcagaggaagccactccttgccctcgttaaagagggtcctgttcctctcttcctgttgatgaaggagcgtgagggtgttagcagtgtgagatctttggacacccatggaatcctttcctccacaccacccgtgcacttgccaaagacagggatgaggcaagtggttcttcctggggcccggccgatcctcaggatgcagagaagtcatgtagacccaccagccccaccttggggggaggcgtgccagcctgtgtcaggtgtgcttgtgtattgctgtgctgtcatggggccctctccttgagagccgcctctctgttcttcctgtagtatattcccctttgaaccaccctttcctgtctgaattctactttgcctcctttctcttcctcctctttgcatggtttgtgtgtatagacagtggaacctgaggatgggatctgctcagcctatcttcggggcaattgctgagcttcaggatgggctattaatgtgggataagcccaggtgcaaggggaggagggcaggctgggaacagagcggagaatgcccatggccctttattccttcttccctcggtccacgaacaggaagaggctgaggccatgctgggcagggtctggatgcccactttccatgcagcagcatttcattgctcaaaaccatccttcctttcctttcgcccttgtttcccacattcccttcgtcctgcccaagggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttcctaaccctgatctcatacttgtatagagtaataacaacagttgtacttccaccaaaggcatgtggcatatttaccaatgtcatgtattctgaacaaaggcaaaaaatacaaattcctaccattaaa

SEQ ID NO: 34192 - DNA, 1113 bp, Homo sapiens
agtaagttccagcgcagctagaccgcggggtagtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaatctacttttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggccactggtaggagctagggaggggctgggaagatggcagctcactcagtactgcctggtcatgtggagctttccttcctggaccaggcctgaagagggtcctgggggtggaccaaagtccaacttggtttcagtgcagtacccttttcgaaagtaaaaacttgttttttgtagttatttctaatctgttcgtccaggattttccgtgtcttt

SEQ ID NO: 34193 - DNA, 1111 bp, Homo sapiens
agtaagttccagcgcagctagaccgcggggtagtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaatctacttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggccactggtaggagctagggaggggctgggaagatggcagctcactcagtactgcctggtcatgtggagctttccttcctggaccaggcctgaagagggtcctgggggtggaccaaagtccaacttggtttcagtgcagtacccttttcgaaagtaaaaacttgttttttgtagttatttctaatctgttcgtccaggattttccgtgtcttt

SEQ ID NO: 34194 - DNA, 1068 bp, Homo sapiens
gcggggtagtcggcgcgaggcggagcttggcagttccgtccacttcagccgcagcgtccctcaccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaaggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttcctaaccctgatctcatacttgtatagagtaataacaacagttgtacttccaccaaaggcatgtggcatatttaccaatgtcatgtattctgaacaaaggcaaaaaatacaaattcctaccattaaa

SEQ ID NO: 34195 - DNA, 2153 bp, Homo sapiens
atctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctcccccaaccctcagccgttcctccacctctcagccatatctttcagcccccactcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttttagaccccccatattatcccagtgtcccctgcccccctcttcccccaccccatgcccccaattctgtggcgcatccagattgtgaaaatgtacaataaatgtgtaatgagtaacca

SEQ ID NO: 34196 - DNA, 2205 bp, Homo sapiens
agtgacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagagaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatga

SEQ ID NO: 34197 - DNA, 689 bp, Homo sapiens
gctcttcctccggggccgctggcactgcggccgctccgcaggcagagaagccgggagcgggcgaggcggcggcggcagcagcgatggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatgagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactgacccagctggtcctgaaggagaagccaaatggctgcactggccgattctggtctccagaggaccttggtgtttgctctcccttgacccaccccagtgagtgccaaagggcagccccaacatgtgcacccctgcatttcctgtcatgccacagactggcccttgagggcagcctgctgtactggccatgctgggccagccccacctggagctcagtaaaaactgctgtttgattaaaagctggtatctgtgtgtgaa

SEQ ID NO: 34198 - DNA, 2496 bp, Homo sapiens
ggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaattatttgtttcattacatctgccaagacaggattgtatatctttgtatcactgatgatgattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagtctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatga

SEQ ID NO: 34199 - DNA, 2646 bp, Homo sapiens
tcccactcccaagaggccacgcgtagacggggcgcttcatgcggaagtcagcggcgtccggtcccagcctcctctgggagcgggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaattatttgtttcattacatctgccaagacaggattgtatatctttgtatcactgatgatgattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagatctggtagctcagcgaggagaaagattggaattattgattgacaaaacagaaaatcttgtggattcttctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatga

SEQ ID NO: 34200 - DNA, 658 bp, Homo sapiens
agttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagatctggtagctcagcgaggagaaagattggaattattgattgacaaaacagaaaatcttgtggattcttctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaa

SEQ ID NO: 34201 - DNA, 774 bp, Homo sapiens
ggaaacctgagttaggtgtggctggagcgactcgagatgcgaggtgggcgggggcaggctgaaagttggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 34202 - DNA, 1215 bp, Homo sapiens
ctagaggggcggaaagtaacaaggaggtgggggtacaaatcctcagctcctgcttccgcaagcactaacctgctctgaagtgagccaggcagctctggccatcttttcccagccacagaatcaggtgatggtccagaattaagagctgtcacctgtgtcattcactcacaatggaagaaatgaagaagactgccatccggctgcccaaaggcaaacagaagcctataaagacggaatggaattcccggtgtgtccttttcacctacttccaaggggacatcagcagcgtagtggatgaacacttctccagagctctgagcaatatcaagagcccccaggaattgaccccctcgagtcagagtgaaggtgtgatgctgaaaaacgatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacgtgagcctctcctaagtctcctccagcaagacagatgcctagcccgtcctcaggaatctgccgccagggagaatggcaaccctggccagatagctggaagcacagggttgctcttcaacctgcctcccggctcagttcactataagaaactatatgtatctcgtggatctgccagtaccagccttccaaatgaaactctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgcta

SEQ ID NO: 34203 - DNA, 794 bp, Homo sapiens
ctagaggggcggaaagtaacaaggaggtgggggtacaaatcctcagctcctgcttccgcaagcactaacctgctctgaagtgagccaggcagctctggccatcttttcccagccacagaatcaggtgatggtccagaattaagagctgtcacctgtgtcattcactcacaatggaagaaatgaagaagactgccatccggctgcccaaaggcaaacagaagcctataaagacggaatggaattcccggtgtgtccttttcacctacttccaaggggacatcagcagcgtagtggatgaacacttctccagagctctgagcaatatcaagagcccccaggaattgaccccctcgagtcagagtgaaggtgtgatgctgaaaaacgataagaaactatatgtatctcgtggatctgccagtaccagccttccaaatgaaactctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgct

SEQ ID NO: 34204 - DNA, 486 bp, Homo sapiens
catcagcagcgtagtggatgaacacttctccagagctctgagcaatatcaagagcccccaggaattgaccccctcgagtcagagtgaaggtgtgatgctgaaaaacgatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacataagaaactatatgtatctcgtggatctgccagtaccagccttccaaatgaaactctttcagagttagagacacctgggaaatactcacttacaccacc

SEQ ID NO: 34205 - DNA, 451 bp, Homo sapiens
accccctcgagtcagagtgaaggtgtgatgctgaaaaacgataagaaactatatgtatctcgtggatctgccagtaccagccttccaaatgaaactctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgcta

SEQ ID NO: 34206 - DNA, 2212 bp, Homo sapiens
gcggtcgggagtaaaatcgcaggagtgggagggtagcgagccagctggattccgagccgcggagcgcgctggctttgctccgcctgatgactccagagcgcgggtccaagcgccgcccatgcagcacccctgagctccggggaaggagagttaatgaaaaaacacttaaccgtctccgctgcggagagtcatgagctgtctggatgttatgtaccaagtctatggtcctccgcagccctacttcgcagccgcctacaccccctaccaccagaaactagcctattattccaaaatgcaggaagcgcaggagtgcaatgccagccccagcagcagtggcagcggcagctcctcattttccagccaaaccccagccagtataaaagaggaagaaggcagcccagagaaagagcgcccaccagaggcagagtacatcaactcccgctgcgtcctcttcacttatttccagggggacatcagctccgtggtggatgaacatttcagcagggccctgagccaacccagcagctactctcctagctgtaccagcagcaaagcaccaaggagctctgggccctggcgagactgctccttcccgatgagccagcgcagcttccccgcctccttctggaatagcgcgtaccaggcgccagtgcccccgccgctgggcagccctctggccaccgcgcactcggagctgcccttcgccgccgccgacccctactcgcccgccgcgctgcatggccacctgcaccagggcgccacggagccctggcaccacgcgcacccgcaccacgcgcacccgcatcacccctacgccctgggcggcgccctcggcgcccaggccgccccctacccgcgccccgccgccgtgcacgaagtctacgcgccgcacttcgacccgcgctatgggccgctgctgatgccagccgcctcggggcgcccggcccgcctcgcaaccgccccggcgcccgcgcccggcagtcctccctgcgagctctccggcaaaggcgagccggcgggcgccgcgtgggccgggcccgggggacccttcgcgagcccctcgggggacgtggcccagggtctgggcctcagcgtggactcagctcgtcgttattccctctgtggtgcatccctcctgagctgatctgctgacccagggtttccccttccccttcccttctgaccagccttggaggctcagcatctgtgcctctcactccgtggatgaggacatgggggaaggcagagacttcagacttctcagtgtgttgggaaaaccaaaaaccacaactacagaaattcatctaaaaataagtcctgctgctgaaagagcaaatccaaagactgagttatgtttaatgacttttggccgaatcactggaaatatctgtggtgagattgctgagtcaggtgatgtgatatcataagctttcttggaacgggggaaagaaaatgaaactttttggtgtgaatattttttatgctgatgtgaattattttgttaggtagtgtgattatagcactactactgtcagattttaaattgtatgtgtacttgcatctaagactgtggtagagaagtaaagagaagtcaattccttcttcctcacctctcagcctccagatcccttcctgcccatcccttccctacaatgcccactccagacgcaaagatacacttttttcctttggactgtgaacatggaagcctcagcctgaatgtgagtggcaagtggcttatctggagccacctgcccaagtcttactaaaatgcagctgttgttagacaactgttgaaaactccagaaatacatcacccaaggtggcagttctcagtatttggcagaacaattgcaattgcactgggtatattatatatatatatgtatgcatatatatcatattttttacaaggaacattttatgatgaaagaagaaacccttctctgccttctctcccacgaattctgtccctgtatcctctggatgtaaaaagcaaggagagaccccaactgtctccatggagaagaactaggaatcaccacaaggggaagaaatgtacatgaagtctccattacctcgaatttttttctcagtctcactggttgtgatttggtcactttagtgttgggacaggggaaagggtctgtgcgtgggcaaagctgaaggtgatgaggaagaagagacgaacattaaagatgtctatttacta

SEQ ID NO: 34207 - DNA, 1709 bp, Homo sapiens
gcttctgccctggagcgcggtcgggagtaaaatcgcaggagtgggagggtagcgagccagctggattccgagccgcggagcgcgctggctttgctccgcctgatgactccagagcgcgggtccaagcgccgcccatgcagcacccctgagctccggggaaggagagttaatgaaaaaacacttaaccgtctccgctgcggagagtcatgagctgtctggatgttatgtaccaagtctatggtcctccgcagccctacttcgcagccgcctacaccccctaccaccagaaactagcctattattccaaaatgcaggaagcgcaggagtgcaatgccagccccagcagcagtggcagcggcagctcctcattttccagccaaaccccagccagtataaaagaggaagaaggcagcccagagaaagagcgcccaccagaggcagagtacatcaactcccgctgcgtcctcttcacttatttccagggggacatcagctccgtggtggatgaacatttcagcagggccctgagccaacccagcagctactctcctagctgtaccagcagcaaagcaccaaggagctctgggccctggcgagctcgtcgttattccctctgtggtgcatccctcctgagctgatctgctgacccagggtttccccttccccttcccttctgaccagccttggaggctcagcatctgtgcctctcactccgtggatgaggacatgggggaaggcagagacttcagacttctcagtgtgttgggaaaaccaaaaaccacaactacagaaattcatctaaaaataagtcctgctgctgaaagagcaaatccaaagactgagttatgtttaatgacttttggccgaatcactggaaatatctgtggtgagattgctgagtcaggtgatgtgatatcataagctttcttggaacgggggaaagaaaatgaaactttttggtgtgaatattttttatgctgatgtgaattattttgttaggtagtgtgattatagcactactactgtcagattttaaattgtatgtgtacttgcatctaagactgtggtagagaagtaaagagaagtcaattccttcttcctcacctctcagcctccagatcccttcctgcccatcccttccctacaatgcccactccagacgcaaagatacacttttttcctttggactgtgaacatggaagcctcagcctgaatgtgagtggcaagtggcttatctggagccacctgcccaagtcttactaaaatgcagctgttgttagacaactgttgaaaactccagaaatacatcacccaaggtggcagttctcagtatttggcagaacaattgcaattgcactgggtatattatatatatatatgtatgcatatatatcatattttttacaaggaacattttatgatgaaagaagaaacccttctctgccttctctcccacgaattctgtccctgtatcctctggatgtaaaaagcaaggagagaccccaactgtctccatggagaagaactaggaatcaccacaaggggaagaaatgtacatgaagtctccattacctcgaatttttttctcagtctcactggttgtgatttggtcactttagtgttgggacaggggaaagggtctgtgcgtgggcaaagctgaaggtgatgaggaagaagagacgaacattaaagatgtctatttactatga

SEQ ID NO: 34208 - DNA, 2475 bp, Homo sapiens
ggctgcccgacccgggcctgggctgtggctgtgactggcgctgccgtgggcgccgcagccctcgcgggagccggacgcggtaatgccccagcggcgcagcgggcggctgcgtccctgagccgctatataagcgcggcagggaacatccggaggggctgaagatgaaggtgcccgcgcatgggcccccgctgattgccagtccctcccgaccccgcgccccgcgcggagcccgaggccgccgaggacccgccttcgccgcagtagcagctggagcagcgacagaggcggcagctgcggcggcggcggcgcccgcgcccctcgcgccagcgcgtagagcggcggcggcagctcgggggccgccactgccccggctgccatgagttgtgcggaggtgatgtatcacccccagccttatggagcgtcccagtatctgcccaaccccatggcagcgacaacctgccccacagcctactatcagccggcgccccaacctggccagcagaagaagttagcggtattcagcaagatgcaggactctctggaagtcacccttcccagcaaacaagaggaggaggatgaggaggaggaggaggaggagaaagaccagcctgccgagatggagtaccttaactctcgctgtgtccttttcacttatttccagggagacattgggtcagtagtggatgaacacttctcaagagctttgggccaagccatcaccctccatccagaatctgccatttcaaaaagcaagatggggctaacccccctatggcgagacagctcagctctctcaagccagcggaatagtttcccaacttccttttggaccagctcttaccagcccccacctgcaccttgtttggggggagttcatcctgacttccaggtcactggaccccctggcaccttttctgcagctgatcccagtccttggccgggacacaacctgcatcagactggcccagcccctccccctgctgtgtctgagtcctggccttatcctttgacatctcaggtgagcccatcctacagccatatgcatgacgtgtacatgcggcaccaccaccctcatgcccacatgcaccaccgccaccgccaccatcatcaccatcaccaccctcctgctggctctgccctggatccatcctatgggcctctgctgatgccttcagtgcatgcggccaggattcctgctccccagtgtgacatcacaaagacagaaccaactacagtcacctctgctacctcagcatgggctggagcctttcatggaacagtagacatagtgcccagcgtgggattcgatacaggctggagtgcaatggcgagatcttgactcactgcaacctctgcctcccgagttcaaccaattgtcctgcctcagccacctgagtagctggaattacaggcatctgccaccacgcccggctaattttttgtatttttagtagatagtcactattttgaatagtgaaggctggcttccctattttgaatagtgaaggctggcttccctattttgaatagtgaaggctggcttccctattttggccaggctggtctcaaactcctgacctcgtgatccacctgcctcggactcccaaggtgctgggattacaggtgtgagccactgtgtccagccctcatgtacaaatttttaagtaaatgtgtgtttaattctcttggaaatatatctaggagtagaactgtggggttaagagaacctcactttttattttatgtatttctatattttttgaatttttttcaaagagcatatatatgcaatttttaaaatatttaaatttaaatttttgttttttaaatttttttttagtatttaaattgttaagattcattacaacatattatagtagagtttgaggtttggtaggcaaaactgccataggaatgaagtaaggtggtccattttttccgaagggctgagtggtggtgaggacagtgaggtgcctctggcacaaaatttaaaaggatccatactgtgagggctgtgcaagtgtatgccaccccatattttgcacccagggctccttattcctctaacctctgtcttggtgttgctttgctgtcatgcgagctcactcttactttttgctccctctgttgaacaggtattacatacaggtaccttgaaatgatcagtatggtatgatcataagtcatttgtatttgccctccacgtgaaaaatgctcatctttaccaagaggctgttatcacaaatctcacattaggctttttccctttcctttatcagtctttaaactgagtttcatgggttccataggaaaaatactcagaatgtgataataagggcttaattgaaaaaagaaaagatctattatcaaatgaatttatttacattgcctaccatatacctcttagagatcacagttccctatagcatataaaatgttttatatattcttcagtaaaaaagcattttaaattgt

SEQ ID NO: 34209 - DNA, 10400 bp, Homo sapiens
cgggcctgggctgtggctgtgactggcgctgccgtgggcgccgcagccctcgcgggagccggacgcggtaatgccccagcggcgcagcgggcggctgcgtccctgagccgctatataagcgcggcagggaacatccggaggggctgaagatgaaggtgcccgcgcatgggcccccgctgattgccagtccctcccgaccccgcgccccgcgcggagcccgaggccgccgaggacccgccttcgccgcagtagcagctggagcagcgacagaggcggcagctgcggcggcggcggcgcccgcgcccctcgcgccagcgcgtagagcggcggcggcagctcgggggccgccactgccccggctgccatgagttgtgcggaggtgatgtatcacccccagccttatggagcgtcccagtatctgcccaaccccatggcagcgacaacctgccccacagcctactatcagccggcgccccaacctggccagcagaagaagttagcggtattcagcaagatgcaggactctctggaagtcacccttcccagcaaacaagaggaggaggatgaggaggaggaggaggaggagaaagaccagcctgccgagatggagtaccttaactctcgctgtgtccttttcacttatttccagggagacattgggtcagtagtggatgaacacttctcaagagctttgggccaagccatcaccctccatccagaatctgccatttcaaaaagcaagatggggctaacccccctatggcgagacagctcagctctctcaagccagcggaatagtttcccaacttccttttggaccagctcttaccagcccccacctgcaccttgtttggggggagttcatcctgacttccaggtcactggaccccctggcaccttttctgcagctgatcccagtccttggccgggacacaacctgcatcagactggcccagcccctccccctgctgtgtctgagtcctggccttatcctttgacatctcaggtgagcccatcctacagccatatgcatgacgtgtacatgcggcaccaccaccctcatgcccacatgcaccaccgccaccgccaccatcatcaccatcaccaccctcctgctggctctgccctggatccatcctatgggcctctgctgatgccttcagtgcatgcggccaggattcctgctccccagtgtgacatcacaaagacagaaccaactacagtcacctctgctacctcagcatgggctggagcctttcatggaacagtagacatagtgcccagcgtgggattcgatacaggtctacagcatcaagacaagagtaaggaatcaccgtggtactgaaacacacaatcttagtgagttaagttgcagcataaatccaagggcccactgggaaaagatactgtcgggtttttccattcagcaataggacacgaaaggcatagaaggagaagacaaagtgtcacgcagttgactggttttcggcctttcttgagaaagcaaagtgggtcccagacattgaagaaaagcatttttatttgtttatttcctcatctgagcctttgccaactgtgcaactctctccttttgttatcttgcttttatcaatatatagctaagtttttgtttcattttgatttttttttttagccaaccaccttgtcaggaaaggatgaaccacacattaaaatgttcattctttcaggaatacaagtttgtagctctatgtgcatctatttttgtagaaatacaaaaagtttggtttagcattgatgggctatttttgagggatgtattttttttaaaattgtaaaaattgttgagttctgtttaaagaacttgctctcagagaagcactggcaaaaatgtttaaaatgcttatctctaagatgtctattatatgctctgtctgtgctttctaggttacctcaaatgttttgtttttttccttcttacaaaagtagctataccgtagtcaaaccaatgcagtattgtttttacattgaatctcagtaaagatttaattccatgctagctcaattagttttgaattatatgtatagcttgaaaagtttttttttaatgactgtgctaaagaaatgatattttattgctttgatttctcccaaagaataacttggaggttgactaataagaaagttggcataaactttcaatcaaatgaagagtttgcctagaggagactaattctctttctagcccatccaaatttgataaatggaaccagaggttatatacaactacaaggaaaaaaatgcatttaaccatgccacctatgagtgccagtgacttattttacttgtttttaattattcattcatggcaatttaaaaagtcatattttaagtgggatttgtttttcctgaagggcatttgaaggaacaatatctgggaaggtactagagaaattacaaagcccgagctctttcttataatgccacctatccctgtaagctaaacaaacaaacaaacaaacaaacaaacagttctatatataatagtttcaacacagaacttaacaagtctctttttttgtttgtttaaatctggctttacttgatttaattcctttttagaaagaaatttagggcaaaataaagtgtatattaggatttaaatttatgccacaatttaaaaataaaaccagaggttatatacaatttaaattgggctaaaaattaaaaatttgaggatttaacttgatatagctctcaggatctaaataaagtttaaattatcattaagacactgctaggagaagattaagattatgaaagtaacagttattgatactgctggacttcaaaggcaaagttcatttcttccattaactgcttccagagatgtcatgtaaaaaagttagtgtattagagaagttttttagctttataaagaggttttttcaaatttctcccatttttctctccacccacataaaatagtatgttcagtgaaatgccactttctatctttaattgttcgtatcatatatgcgaactttttagacatgaacatgacatgttcagctaggcagagttctcatagataattttcaaatattttccttggctgtaatttatgtattcatttatatcctatccgtcttttgagcttcagatctatatactcttttgtactctcatcactccgcactttgctgtttcttacctagactctcttttacacaatatgcacatttttaccattgtggggtccaaatttaagataccttccactcactaataatatgaacttatatttcctgggagtagccaggttaaattttctatactttggtccataatttgatttgatatgattgtttcatttataatttgcccaaatacatggagcacaaaatttagtgaatttataaatctggatttgccttgtgtccttctgagttttcaaaggcaagtattcaacagtccctgtgtgatgactgacagggttatttgcctcatccacatccaccttcggaatacattaacttcctttgtaatttatttgaaagtagtgttaaactcattcagatcattcagttggattttcccaatgaagaggaaaaggaaagtagttattcctagctccatttcttattttccaccaaatttaattgaagggcattaattagatgtcttcaccctgaatttagactttgctctgtgttctcccggtaactgtcagacaaaaagtttattggctctgaggaactgagaaatgttgggaacctggtttctgctgtacacaggaaagatttgtaagtgagctctctctttgaaaacaggacccaggctgggcacagcagctcatgcctgtaatcctagtattataggaggcagaggctcgggaggattgcttgagcccaggagttcaagatcagcctaggcaacatagggagaccctatccctacaaaaaatttctgaaaaattacctgggcattgtggggcacacctgttgtcccagctactctggaggctgagtccggaggaacgtttgagcctgggagtttgagtttgcagcttgcagtgagctgtgattgcaccactgtactccagcttgggcaacagagcaagatcctgtctcaaaaggaaaaagaaaacaggacctaggtgtttggggtacactgccacccagggagtggatcaaaaatatacatagaaagagaatgagcatgtctctataattgtcttctaggaccatattgctgttagaagtcctaaaagaggatgggttgtaatttagcataatattctgaattcattccaagtttaaaatcctgtcattctctggctcttcttttttcacatcaaaatgatgctgttggacttagaggcttccgaactgttttattgagggctactatctgcctccacaattttattaaaaccactccacctttagacaaaggtgacttttgtctgattttacaaatcagattttattcaagctttctaaatatctgtgaagtagaccctagaaaattgtctcgtttattttaaatagaatctatgcttccaccaataaaccatcgggagctaagaaacaacataatgttgacaaatcaggaacctaacagattattttgtctctcattattaatttgaaagagcctctaaacttttgagaaatcaatgtgtcttcttaagaaagttaagcaccctctcttaactttcccctctatttgctctcctttttctttcttcttaagagtatttatattattttgttaagcaaaaatggctaagattgctctaaaatttgcaaaatgaggagtggattgcaaataattgagggatttatttctttaactttataagactttaaaaaaaaaacccaaattctaagcactgacatgaaagttgcctttgagaagcttgttattcattatacaaaaagtatttgcccattcctattctaagatttgcagaatatgtcaccctatctagcttttgagtttgctatctggtttaatgttgtatttataatttaaagtggaaatcagaaactgtttcaagaacctgtattctattccttactgagtgtcccttctttaaatagtgtttgctgaattaagccgatgggggcagtggcgttaagtggtggaaaaaggaaagtatatatgttagagttttgaatgagggataaatagaaagcagaatgaattaatggaaaagaactcggctgttaggccattctctaaattctagtttagccaaaagtttatgtgtggtttggggcttcatttatttatctcatgagtaaaatggaataatacctaacaggcaggctctggaagttggaaatcacatacacacacacacacacacagacacacacacacacgatcaatcatgtagctcatattagatgttcaataaataacagctactacagatgcctatcagttgagtaagtagttcattaaattgagctcccaaaggtctcttctcttcacatccatatccgtttctgcagcaatcaaatagatacatgattgtttttctgtaagaaattactgcaaagagaatctttttctcctactaactgttccttctacctggtataggagataaatgtacgtttcttaattagctgactttttagtatgtcatttctgaaggaaaaataaattaaccttaaagtggcatgtaggtccaattcagttttcctacatgttccaaaattttatttaaattactgtgtccaaaattatgaggacagtgtcattcattcaccatagtttatatttttagttatatatcaaacttccttggcacctaggataagaacatttcttttgaagttatccaatttttttttatttttacttgacttgaaggaaagttggaaaatatggtggaaaaaatcttccgcattaaaagggggaaaaacacaaccatttacgatctcagtcagcagatttactctactcaaggaaaaaaagaaacaatcttattggaagcagatgttgacactgtgtcagttattgaagacggaaggagttcacttgagccattgcagttacaaaggggtattgatggcagtttggattcctgattgatcacctttgcagccaagggaaagacagcagaaactgtatgggatcagaaatgaaatcagcctgccagtttaatggagaggctcctagaaactcattttttttctttcctgtaagataaaagacatctttcagaataagaaaggcttgtttgagagagaaattacagtttattctctgaaaatatttaaaggccaaagtgccctttaaatctattattaaagcattgaaactgttattaaaatcattatagaaaaattaggtaaaaattttagcctaactttcaacatccattcaaaaacgaatgttgaaaacaaacatataacctataaaaaagtgaatggctctggcaagtgggggcatgggtggagtccataaggaaacctcagtctcaataacttcaaaatgttacttttcatggtaacttggtcatggagattggtcacagcacagacatttagaattttttagcaggttttttttttcttttgaatcttgtagtgctctctgggaattgcaccatgtacacttttacaacctacagaaatcgtcattattgttaaagtatctcaacttttctatttcttttattgtctattgtgcttttttgtttaaaaatacttttatagttttaaagtattggtcaaagtagtattctcttgaagttctagtcaatttaatttgatccaataagtttttctgaatctcctttttaagttccaagaaattctattataaataagtgtacttttaccaattccattgtataagcaaacagacaccttttagaaaaggataagtaatcatcaatttgtttttttaaaaaaaaaaacaatttctagactactaaatttggcataagaataattcttttaaaatgcaacatactttaattagtttttttggtatatgcataagatgtgaactttcctattgatatcactttatattaatagagatgtacatttctttctatgccgtggctagagcaaaagttaataatgattatttacacaattgatttaatttcttaggatatgtataatattggatattatatctgatttaaaaatactattccatacattttttttttcaggagataaaacatagggaaaggttttcatgtgaattctttgtatcactttgaagtacatatatttaaagggaagatggatacaatttgtttttattatataaatctaggtaaggtgaaatgcttttgtcaacaaaaatacagtgtagtgaattttatatttgtcacttgattaggtaaactgaaaactaacaatagaaatattattttactgcattgaaataccatgaactttcagacttgttagttctacaagaagttgtgctaccttaattttgtgtttccagaaataaaaattaaccttagttatgctgtcatttttaactaataaaaaaagtataattcataaaacttttggctttataagataattataaaattatatatttttttctgtttttgtggggttgggaaaacattttcttatttctattcactcttcaaatgcaggtctcataatatgtgtcaatgatataagatgatggaagactttgtaataaaaacatatgtcattatcttcaatttgttcaataaataatttaatgtgaattgaatgtttgtattttaacatagcatttggatttggtctgcatttcttgagaatttaaagctctttttgtttcctccttattcaattaagcatcttataaatattttggaaattacaacatcttaggtgttattaattaagaagttaatttctagggccaagaagtctatatgttacagcaaggaatagattataaaatacatgtttataatggaaaagaaaatgaaatggggtatattaattacataacagcaagagtcttgagaattttataatacaatgcttctaaggatattggttgaccaaggtgtattttattgtttttacatttgttgacagggactctgccataagtagtatgaaaaaacaaacaaaaacttttctacgattcattaacattgaaaagagaattccaagaccttgtattctgaagaaagctagagtttctctaagtgggccttcaattttcttattacacgtatctttaatgtgaaagtactaaagtctgaaaatcagcatttaaataatagactttccagcattacagatgaaataatttggcgcaggctttttaactgtctaccatatttagaatgtggtgtcaaaatgagatttttagaactgctgtaaaatattactacattactacaacgataacggcctaaaacaacacaaatttattatcttacagctctgtcagtcagacattcagcaaagatcttagtcttggtgggctacagaatgtaggaggcatttcctggatgcttccaagagagaatcttgctgttccctgcttctagagtcctttgcttagtttccttccatcttcaaatccagcaacctggtcaagaccttctcacatgacatcactgacttcctcttcttcctctcccttacatatttaaggactcatgtgattacaatagctgcatctgtgtaatccagaataatctcttcatctcaaggtttttgttctgttttgtttttttgttttgttttgttttgttttgttttgatggagtcttgctctgtcgtcaggctggagtgcagtggcgcgatctcggctcactccaacctccacctcccgggttcaaaggattcccctgcctcagcctctcgagtagctgggactacagatgcgtgctaccacacaaggctaatattttgtattttagtagagacgggatttcaccatgttggccaggatggtctccgtctcctgacctcgtgatctgcctgccttggcctcccaaagtgttgggattacaggcataagccattgcgccatgctcaaggttcttaattacatctttaaaggccctttttccatgtacagtaacatattcaatggttctggggattaggacttggagccattattctacctacaacaattagtattggacttccatcattttctatcactcttgtaatcgagaaggactatttcactgggagtagcaagtcataatgtttgcgttggcatttgtgtgggggtttatcttcattcattaaataattgcatgtaaagaaaattcctgtcactatttcaaatgtttcatgtagttattatagtgcttcagaatccaaagggttatgtgttacttatgtaagatgagcagtctagggggtggagaacaggtcatctagtgcagattcttcctagctgaagtgtgttttctctggggacaaccaagtaggatttaattgttttgcttccttttttgggaacttagacccatcttgcgatgtcctaagtctccaagcatcttatttgacctgcttatacacatttgactaaatagctaaatatgaccacattgacgtggtaaagctttaacacttttgtccagattgaatcactccatctgctatcagttaagcagtggaaaactgttatggaaaagcaaacatgttttgatagatttaatgtgtaaagaaggtatccatactctggaatgctgctgatcaataaatgagctgcaagactttgttcgaaacaacactcaagcacaactgttttactttccataccaagtttggctgtgactgaatgaagaacatcagcattgatctttgctttgcacttgtacaagagactatttgcagagagccaaatatagcaacagaggatttaatatcttgccaaaaaatacaaaatctgttcccctttaagcatgacactctatcctttcttgtggatcttgctaaaaggaaaatatagctttaaactcccctattccttctgttgaaagcttaagaatctttttcaaatgagctatgtatggttttgtggtattttatgtttccaaaagaaaatggctacatgaaaaatctgtccagtgttatcatttttcttacaaaaaatacttctagttatggttgtattaattaatttgattgtgataatgattacacaatgtttacctatatcaaatcatcatatcgtataccttaaatatatataacttttatgtgtcaattataactcagtaagtctgggaaaatatcgttaagtcaaagattagagtcaacagaaataaagaaaaatcatactttgataacttcaggactaatcaaggatcaatgggtgacatgatatcatgctatgtgccattttgtgttaaacaaattacaccaacaataaaaaaaattggcttcaatcaa

SEQ ID NO: 34210 - DNA, 2147 bp, Homo sapiens
gagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctag

SEQ ID NO: 34211 - DNA, 4981 bp, Homo sapiens
gagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgaggaaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtgtgtgtgtgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataatgct

SEQ ID NO: 34212 - DNA, 5123 bp, Homo sapiens
cagactttgagggaagctcactcaggatctgctctccggcaaagtagtaagtgaggtgctgagagcagaatgagctactttgtggattctgctgggagcagccccgtcccttactcagcgcctcgtcctgcagtggtgaggcaaggacctagcaacacttatgaagatcctcgaatgaactgtggtttccagtccaattatcaccagcaaagaccttgctaccccttttgggatgagatggcaactcaggaagttcctactggtcttgaacactgtgtctcagatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgaggaaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtgtgtgtgtgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataa

SEQ ID NO: 34213 - DNA, 1494 bp, Homo sapiens
ttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaa

SEQ ID NO: 34214 - DNA, 2134 bp, Homo sapiens
ggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatcccttta

SEQ ID NO: 34215 - DNA, 4594 bp, Homo sapiens
gagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccgggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgaggaaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtgtgtgtgtgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataatgct

SEQ ID NO: 34216 - DNA, 2575 bp, Homo sapiens
gcggtggaggcgcgggcgctgtccagcgtgctgaagccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagctgtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgcccgacagcgggccccttcccgaaacccacaagttcggggaaggagtgtcctcccccaaaacacacctaggcgaggcattggcacccctgtccaaggcgtaccaaggcgtggccgccccgttccccaaggcgcgccggccggagagcgcactcctgggcggctccgaggcgggcgagcgccttctccagcaagggctggcgcaggtggaggccgggcggcggcaggcggaggccacgcggcaggccgcggcgcaggaagagcggctggccgacctcgcctcggacctgctgctccagtatttgctgcagggcggggcccggcagcgcggcctcgggggtcgggggctgcaggaggcggcggaggagcgagagagtgcaagggaggaggaggaggcggagcaggagagacgcggcggggaggagagggtgggggaagaggatgaggaggcggccgaggcggaggcagaggcggaggaggcggagagggcgcggcagaacgcgctcctgttcgcggaggaggaggacggggaagccggcgccgaggacaagcgctcccaggaggagacgccgggccaccggcggaaggaggccgaggggacagaggagggcggggaggaggaggacgacgaggagatggatccgcagacgatcgacagcctcattgagctgtccaccaaactccacctgccagcggacgacgtggtcagcatcatcgaggaggtggaggagaagcggaagcggaagaagaacgcccctcccgagcccgtgccgcccccccgtgccgcccccgcccccacccacgtccgctccccgcagcccccgccccccgcccccgctcccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtgactgcccttcccggtcccgcccccgcgcgcccccgccgcgcgcgcgcgccggcgcccccctccgtgttgcccgctccccctcggtgtttgcatgcgccccggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactattttattagga

SEQ ID NO: 34217 - DNA, 2477 bp, Homo sapiens
agatggctcagggaaggggccgaggaggccctgggtaagcgagggcttcgggggttattttcccatttacacggctccagagatcggcacaacatcttcctcctttgctcctaaacgttcctcttctggtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgcccgacagcgggccccttcccgaaacccacaagttcggggaaggagtgtcctcccccaaaacacacctaggcgaggcattggcacccctgtccaaggcgtaccaaggcgtggccgccccgttccccaaggcgcgccggccggagagcgcactcctgggcggctccgaggcgggcgagcgccttctccagcaagggctggcgcaggtggaggccgggcggcggcaggcggaggccacgcggcaggccgcggcgcaggaagagcggctggccgacctcgcctcggacctgctgctccagtatttgctgcagggcggggcccggcagcgcggcctcgggggtcgggggctgcaggaggcggcggaggagcgagagagtgcaagggaggaggaggaggcggagcaggagagacgcggcggggaggagagggtgggggaagaggatgaggaggcggccgaggcggaggcagaggcggaggaggcggagagggcgcggcagaacgcgctcctgttcgcggaggaggaggacggggaagccggcgccgaggacaagcgctcccaggaggagacgccgggccaccggcggaaggaggccgaggggacagaggagggcggggaggaggaggacgacgaggagatggatccgcagacgatcgacagcctcattgagctgtccaccaaactccacctgccagcggacgacgtggtcagcatcatcgaggaggtggaggagaagcggaagcggaagaagaacgcccctcccgagcccgtgccgcccccccgtgccgcccccgcccccacccacgtccgctccccgcagcccccgccccccgcccccgctcccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtgactgcccttcccggtcccgcccccgcgcgcccccgccgcgcgcgcgcgccggcgcccccctccgtgttgcccgctccccctcggtgtttgcatgcgccccggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactatttt

SEQ ID NO: 34218 - DNA, 1622 bp, Homo sapiens
gccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagctgtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgcccgacagcgggccccttcccgaaacccacaagttcggggaaggagtgtcctcccccaaaacacacctaggcgaggcattggcacccctgtccaaggcgtaccaaggcgtggccgccccgttccccaaggcgcgccggccggagagcgcactcctgggcggctccgaggcgggcgagcgccttctccagcaagggctggcgcaggtggaggccgggcggcggcaggcggaggccacgcggcaggccgcggcgcaggaagagcggctggccgacctcgcctcggacctgctgctccagtttgctgcagggcggggcccggcagcgcggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactattttattagg

SEQ ID NO: 34219 - DNA, 6531 bp, Homo sapiens
acaaaggtcgctcttctgcagccagcttgccacaattccctgagatctcccaggtggcagctgcctccccaagacaggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtggccaaagtggaacaggtgaagttcgatgccacatccatgcatgtcaagcctcaggtggctgcccagcagaagatggtagatgatgggagtggggaagtgcaggtgtggcgcattgagaacctagagctggtacctgtggattccaagtggctaggccacttctatgggggcgactgctacctgctgctctacacctacctcatcggcgagaagcagcattacctgctctacgtttggcagggcagccaggccagccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtcttcttctggattgggaaacatgccaacgaggaggagaagaaggccgcagcaaccactgcacaggaatacctcaagacccatcccagcgggcgtgaccctgagacccccatcattgtggtgaagcagggacacgagccccccaccttcacaggctggttcctggcttgggatcccttcaagtggagtaacaccaaatcctatgaggacctgaaggcggagcttggcaactctagggactggagccagatcactgctgaggtcacaagccccaaagtggacgtgttcaatgctaacagcaacctcagttctgggcctctgcccatcttccccctggagcagctagtgaacaagcctgtagaggagctccccgagggtgtggaccccagcaggaaggaggaacacctgtccattgaagatttcactcaggcctttgggatgactccagctgccttctctgctctgcctcgatggaagcaacaaaacctcaagaaagaaaaaggactattttgagaagagtagctgtggttgtaaagcagtaccctaccctgattgtagggtctcattttctcaccgatattagtcctacaccaattgaagtgaaattttgcagatgtgcctatgagcacaaacttctgtggcaaatgccagttttgtttaataatgtacctattccttcagaaagatgataccccaaaaggagcctatggtcctcatttcaacttctaaggtcgctagattgtttctatcctgaggtattgcatcaattttaatactcctatagttttctcttcttagaagagcacaaacactccatggaacattagagttctgaggcactaccctagcttgtcctctatcatgactcatttttatctatggcaggtaggctgaagcactttgcaggtttacatcttccccagagtaacagcttttccttttcacatatactttccttactgccttactcagtgggtaagttaaagggctgaaggagagttgaatggtccacaagactaccctcttaagaggtttcacaaattccaaacagtaccagtgagagcagcacttccactggggctaggcttgagacctaaaggcaagtatgaaatgcatatgctacttcactccctctcccaacccttaataatgaggcaaagcaagagcctagtgaaggccaatgctaggtttacaaacttacccagaagcctctgcaaagcttcacaggctcctcagatgaaaataacaggaatcaatggggactacggccagacactggtttgccattctgttccttttaagaagtaacagtgctgcaaggaagtccatgtcagaaagccaacagaaggtgatttccacaactttgaacaggttgttacaagtatcagcaagaatgtgtccttttcagaaataacagtcaaatcaaagaaggttaataaaggctttaatttcatacacacaaaaaaactctatgcataatttaaaaaggaaacaaaaacaaagaaaaaccgtaaaggatacagaggaacagttctgctaaaacacagataaaagtgccgctccatacaaaacataaagaatcagaatcaaaagtcactctgaacataaagaaaaaaaatcatctcacaaataatgtggccacagctgccagaaaacctggtagtggctcaattaggcaaagtgtaggaatctcatttttgtttttctctccttaagtttaaagaaacaacaatgacaataggccagagaagttagggagggaaagaaaagctcaaagggagggaaacctggggacaagaggtgtgcacacccacatgtggtctcactcttcacacaggcccactatttttgaagtagaccagtttagttgactgttcttctttgttctggcatctgactggaccaacctggaacctggtccagaccctcacccactctattcttatgccaatggacatacctatactttgaacctctgtacttttaagaaaagtccaatgttacaaaatcaaatgcttatattcagactggcacactttttaaataaaaactccatacacctcagacatatagcacacatggagacaacttactaattgtgtgtaagtatgatacaatgaatgagactgcctgaagtctagtaatcaaagcatgccataaggtgaatgattgtggttaaacacagcaaaataattgtcacaaaactttcaaggcctaacaaattagaattttccaataaaaaatatatattttttcagatgttaataagacatatcagtagagacaaaattaggattttgaagtaatgcaataaaaagatgttggagggcagaagtctatttagtttttgtatacacttgcaagagtgcattactcagtataaagcaaaatggggaggaaaaagacatccatccattttattggaacacttttatgtgacttgaatctggtgttaggttgttgatttttctaaaaatctcctatatatacaaaatccatatgtacttggagatccagctgttgccccctgtttaaaacaaaagaccacctcggggggtcaattaaattaaaaaggccctccaaccaccctaaatgggataactaagagtatctactgcagtcatttcagaggacagagaaggaaaatattttaatttgctttaatataacctcttttcagtagatcacaaatgagtttacaaactacttttttttctctttaatttaggtgtttgcagataattttcattatatccgtagctgtatgtgtgtatagttacataatggtaactacacacgatacagaagaatcagtaaattcatggattattttgctgaggttttaaattttaaagcctctgtttcagaattttatacttgatcaaggagaaaaataaatgtgtagtctaacatttgctttctggagttaattaactgatctgtaagaaccactgcatatgtcttaaaatgtaaacatatttacatttgttgtatttgttattgagcctttaaggttaggcccagaatgaacagaccatagcaagtaaacaaataatttttagaatcaaagtattaatagaagaccagttcatggatttgcttattctatcctgctgagacaaaactcatgagtgtgcacacacatgtgaatatatccctacgaaacagtctatcttctcataggcttaaattatagtcatggctattaaagaaattaacagcatccagccacatgcaactttccaaccttcagtactattaggtgattaaaatcaacaaatatgaagtttagttcatttttcccttaaaattccaacaaagatcaaaaggttgtatctagaactaattgccatcaagttccaattcaatgtcatttaaagtaatgtaaccacacatttggtattttcaataggaaggttaattaggtattgtgcaaactgcctgcaacggaagcactcagtccttatctaacttgtcccttcctggccccaacatgctaactgccccatccccaattctgggcaaactgatcacaatgtgcaaaaaataatatattatctatttataattttaaaatatatacagccagctcaaaaacaacaacaaaccccatcaacatagtccagctgaaatctccactggtagtcaaagaagtagattaaaggagtaaaggaaggagaaggctgatagggccacaagaatggacagacatcaagtaaaatttgagtcccaaacatgcaagtacatgagcagtgagataacttatatattccaataacctattttcaacaactcctgcccaagacatgaagatcaaatcaggtttctgaggtaagtgtacttctaaaccatacacacatgaaagctatgaaagcaattcaaatgaggctgcttcatgaggcaatctagacttatggcattatttctacttttctccatgttttaattgcagcctgcactttaaatctttcccaataatttttaacagtgcctctcaaatgcaaagacacgtaaaagaattaataactagccaaagaattttatcaccgcttcactcatttataagaaaaccaattatttccaagcaaaatcaaaccaaaccaaagaggctcctggtagaaatgaaacaaaactttaaagctagttttaaaacaaatattttcctctgctctaaactactctggcgttttctaccactctaccattttggaacattcattacaataaggtatataggtagatggtaggaggcaaagcatttatcagtagttgagcaaaactgctgaggccatttataattcaaagaatgaaaacttagaatagtttactacattagaatacatccaagttccaagagtaggactggagctctcttaaggcaatctttcagaaaagatgttgcatcttctgtgatgatggtttgtgttttttttgtttttgttttcgttttttttaatgagatggagtctcac

SEQ ID NO: 34220 - DNA, 1968 bp, Homo sapiens
acaattccctgagatctcccaggtggcagctgcctccccaagacaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtggccaaagtggaacaggtgaagttcgatgccacatccatgcatgtcaagcctcaggtggctgcccagcagaagatggtagatgatgggagtggggaagtgcaggtgtggcgcattgagaacctagagctggtacctgtggattccaagtggctaggccacttctatgggggcgactgctacctgctgctctacacctacctcatcggcgagaagcagcattacctgctctacgtttggcagggcagccaggccagccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtcttcttctggattgggaaacatgccaacgaggaggagaagaaggccgcagcaaccactgcacaggaatacctcaagacccatcccagcgggcgtgaccctgagacccccatcattgtggtgaagcagggacacgagccccccaccttcacaggctggttcctggcttgggatcccttcaagtggagtaacaccaaatcctatgaggacctgaaggcggagcttggcaactctagggactggagccagatcactgctgaggtcacaagccccaaagtggacgtgttcaatgctaacagcaacctcagttctgggcctctgcccatcttccccctggagcagctagtgaacaagcctgtagaggagctccccgagggtgtggaccccagcaggaaggaggaacacctgtccattgaagatttcactcaggcctttgggatgactccagctgccttctctgctctgcctcgatggaagcaacaaaacctcaagaaagaaaaaggactattttgagaagagtagctgtggttgtaaagcagtaccctaccctgattgtagggtctcattttctcaccgatattagtcctacaccaattgaagtgaaattttgcagatgtgcctatgagcacaaacttctgtggcaaatgccagttttgtttaataatgtacctattccttcagaaagatgataccccaaaagg

SEQ ID NO: 34221 - DNA, 1454 bp, Homo sapiens
caggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtgggtgagggccaggcgggggcagtgagggagccaggatccaggagctgggccaggagagccacttggtccaccacccaccctccttccctgacgtgcatcttcaacgaagacttttacgctggctctgggcttgtcctagcagatggggacgtggacaaactctagttgtcacaaaaagggagctgagagggctgggcatggtggcacatgcctgtaatcccagcactttgggaggctgaggcgggtggatcacctgaggtcaggagtttgagattagcctaacatggtgaaaccccgtctctactgaaaaaaagaactaataaattagccaagcatggt

SEQ ID NO: 34222 - DNA, 1892 bp, Homo sapiens
gcgcatccagctccagggaccctaggttttctatgggattcccaatctgcagcagagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtga

SEQ ID NO: 34223 - DNA, 1543 bp, Homo sapiens
caaccttcccgaggcgtcctgcccgggaagccagttcctgggttctgggctggctaggttggcagcgaatgaggcttaggcatcactgcctgaggccctcacttagcatgtcgacagccacagacttgtctggcggagtttctcctggtgcccacttaagtagtctcaagtttgttcaaagctggactcctcgacttggaaccaggagcagctggagatttgtcaatttagagctcatttgccacgggagacgctcttggtgtccccagcaccgaagggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatatta

SEQ ID NO: 34224 - DNA, 2725 bp, Homo sapiens
agactagatttaagacaggtgaaactgagatgctttcttagtttgtcttagacagatttaagtagctaattgaccgattgtgaagttttccggttgctgataaaactattgagcgggtacagtcgagtagcaacctgtcatccgtgggattggtgcaccatttttctcactgtggaagggcagcaaaggtgtttgctaagtaaaactgagtggatgagattggtatggaaatcatggttgatctctgagcgggatgttagtgtttaagatccacggagtcaggcgcaaaatgagcacatttctctcagtattcagaaatgagtagataatttttttcgtctttgatttttgtcacaatggtgaatgggcagaaaagggaaagatgctctactgcactgtcgattttgaacggagtcacaggctcggtcgctgaatggggactgtcagacccaaactagttacctgcctttgcattccgtgttcgccatccggaatctggggttaaaaaatgtaaatcaaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgactttggtgctaacaacgtatgttcagtgcaactacgtggagctgtgcacacacagcaggtaggctgcaggtgtcccccaacataagtcagtaggaaagaagacatctgtcttcccaaatctaaagtaggcaaaaaataacagaagtagctatttttaataacagaacagaactctgactcttttgatcttgaaggaggcagaagagattccatcaaaacctctaaaagcaggtttgcattttcagaacatgcccccctagagagttgagttttttacacagcactacccggtagtactttctctgatgatgggaaggtctacatctgcacagcacgctagctataactgcacatatggctactgagcacttcaagtatggctagcgtgactaaggaactgaattttatactgtaattaagtgtaatttgccacatatagctagtggctttagtaacagacagtttagtgctatattatttattcaagtactttttatcaaattcgttttttaccgaattcgttttttaccattctttatttgtcttaggatcattacataacactaaactagggtctaa

SEQ ID NO: 34225 - DNA, 562 bp, Homo sapiens
aatctgcagcagagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgacttactggattatttccaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggcct

SEQ ID NO: 34226 - DNA, 576 bp, Homo sapiens
agtgcatacagaaggcgcttggctcagggtacacagggcaagaagcctcggatcccagctccctttaacacacattttttcaacgccgttctggaccgagactgtccggggcactgggtgctgcaggacccggctcccagtactcctagcagaagaccctctgatgaaatggcccatgacaaaatgaccaccataaccgttccttcagtaagccaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgag

SEQ ID NO: 34227 - DNA, 948 bp, Homo sapiens
tccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacaggtgtctggggtcccttttctccgctccaaagataccacagagaacgtgtcattcccacattcagtgagccaatcagcagtcccttctctatagccaacacgctccctttgcatagaaactgagggtcccttagctgaaggcaccacaagagcttgcccctatgaccctcatgccttttttcattttattattatttagtatcaaatcattctttaaaatcacatgataatgtgtgctgcaactagaaactataaagatatgtcaatgaaaaaaaaaaaaaagagac

SEQ ID NO: 34228 - DNA, 2157 bp, Homo sapiens
ggggtggggtgggctggacagaagagaggaggagaaggaggtgactgaggggactgcagctgggtgggcggtaaccgaggggaggggaactggtggcgtccccatctcgcggggtccggaacggcgacgcgcccgcgcccagctgattggagcccttcaggcctcccgcgcccgaccggcagcccaatcctataaagcttcctctaagctgggccctccgcaaacgggatccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacaggtctggtttcaaaaccgcagggccaaatggcgcaagcgggagaagcgctggggcggcagcagcgtgatggccgagtacgggctgtacggggccatggtgcgccactgcatcccgctgccagactccgtgctcaactccgccgagggcggcctgctgggctcctgcgcgccctggctcctggggatgcataaaaaatccatggggatgataaggaagccaggaagtgaagataagttggcaggactctggggctctgaccacttcaaagaaggttctagccagagtgagtcaggatcacagagaggctcagataaagtgagccctgagaatggcttggaagatgtggctattgacctctccagctctgcccggcaggagaccaagaaagtgcaccctggggctggtgctcaaggaggctccaactccacggcactggaggggccccagccagggaaggtgggagccacatgagacccacaggtcccactgtcaaaggctgaaaatgtgcatattcctcactggcattttccaaaagacaaaaattgtccaagacatatactctcagtttgattttcttctgacaatgtcaagataaaatgcaatgccacttgctttaagaggacagatgagtgacctagggaaaattctatttcattctagaatggaaacggttccttaatggcactttaaccagttaacttggtgcaaaacttttgattctcttttgtagcttgagcagggaggatccgaagttcaaaaatgatttcactgctgggcatcatttgagatgtgtggttcaatgtactgtatagatgaataggttaggtctgatgtcctcattctcaattaggaaatataaaattgtttaatatccagaagaatctgatatcatcatagtgaagactccatacagacacatgaatgaattatattgtctttaccttgaacttggccttggatatttcaattttcttgttagggagtaattttgtgttttcttgagtgtcacttgataggctatgcatattggaattcaaagaaacccatactctagtcgtttctgcatttcctttaaaaatagcatgggatcatatttaaacaattgttggatagctggaaacagtgtttttaggtcagaccaggcttttggtctttcaaaatttgtgattgaaagcactttagtgacttggattttgtaaatctttcctttcctgcgtttcctttgccatttatttattctttaaaaataaacattttgtggtgtgt

SEQ ID NO: 34229 - DNA, 696 bp, Homo sapiens
ggggtggggtgggctggacagaagagaggaggagaaggaggtgactgaggggactgcagctgggtgggcggtaaccgaggggaggggaactggtggcgtccccatctcgcggggtccggaacggcgacgcgcccgcgcccagctgattggagcccttcaggcctcccgcgcccgaccggcagcccaatcctataaagcttcctctaagctgggccctccgcaaacgggatccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgcgatgtga

SEQ ID NO: 34230 - DNA, 1107 bp, Homo sapiens
ggggtggggtgggctggacagaagagaggaggagaaggaggtgactgaggggactgcagctgggtgggcggtaaccgaggggaggggaactggtggcgtccccatctcgcggggtccggaacggcgacgcgcccgcgcccagctgattggagcccttcaggcctcccgcgcccgaccggcagcccaatcctataaagcttcctctaagctgggccctccgcaaacgggatccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacaggtctggtttcaaaaccgcagggccaaatggcgcaagcgggagaagcgctggggcggcagcagcgtgatggccgagtacgggctgtacggggccatggtgcgccactgcatcccgctgccagactccgtgctcaactccgccgagggcggcctgctgggctcctgcgcgccctggctcctggagggtgagacattgggctgcagagaaatgaagtga

SEQ ID NO: 34231 - DNA, 921 bp, Homo sapiens
ggggtggggtgggctggacagaagagaggaggagaaggaggtgactgaggggactgcagctgggtgggcggtaaccgaggggaggggaactggtggcgtccccatctcgcggggtccggaacggcgacgcgcccgcgcccagctgattggagcccttcaggcctcccgcgcccgaccggcagcccaatcctataaagcttcctctaagctgggccctccgcaaacgggatccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacagagggtgagacattgggctgcagagaaatga

SEQ ID NO: 34232 - DNA, 1977 bp, Homo sapiens
tccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacaggtctggtttcaaaaccgcagggccaaatggcgcaagcgggagaagcgctggggcggcagcagcgtgatggccgagtacgggctgtacggggccatggtgcgccactgcatcccgctgccagactccgtgctcaactccgccgagggcggcctgctgggctcctgcgcgccctggctcctggtgcaaacttctgctcctggaggctcccgttcactggactttgcaggagacacacaggctccccagaccccgtggtggtgcctgatgaccttcagctgaaccctgtaatgctgctaaagtctgcccctctggagaagtgctcaggtagcattgttctgcctcaggaagcatgccgattttcctgtgtcatccttgatgatcactgctaccagacttgccccctgcagggcaccccatgtgcaaggaattcaacaacctaggagttgaaagcattggtctcccaagttcagtgtgttcttttccgtatctattaccagctgatgagaataaacctgcagtcatgacagctaggtcctagtgacaggtgcagaaagctgctcttacagaaactcccctccttattaagaggctttgtctatcactcggaactgcttctactcaagattatctgttgaaagggaactgtccataccagggcattgttctgacttttctggacttcctcaacccaaaatgccttgaagaaaaaaaaaaaagaccctgagtgttagggcagggtctcactctgtctccaggctggagtgcagtggcacaatcatagctcaccgcaacctctaactcctgggctgaagtgatcctcccacctcagtctcctatgttgctaggattacagcgtgagccactgccccagctactccaacttaagagttcccccaaggctggctgcccttctcctctccttccatcatgaatgacacatgggcatccccttcggctagcatggctgacctgtgcctgcctgggtgctcagcttggcacccatgtgagtttgcagcctgaaattttaaatggaggagtttctgtgcttttctgccctgattcctcttactgaccctctaagtcaccagctgtggtcgtctcctctttgacccctgatctcaacccgggctttgaaatgtgtttgttcacataattgtccattacccatccttcctgtcattgcagaatctgttgtctcatactgacattttaagactttttttcactttcttctgttgaagatcacctactaagaagtacttcctccttttcattctttctttataagaattaattaaattttaattgacaaaaa

SEQ ID NO: 34233 - DNA, 1195 bp, Homo sapiens
tccagagaggctcgcgccttgcttgctaaggaaccatgaccggccgggactcgctttccgacgggcgcactagcagcagggcgctggtgcctggcggttcccctaggggctcgcgcccccggggcttcgccatcacggacctgctgggcttggaggccgagctgccggcgcccgctggcccaggacagggatctggctgcgagggtccggcagtcgcgccgtgcccgggcccggggcttgacggctccagcctggcgcgtggggccctaccgctgggactcggcctcctctgtggcttcggcacgcagccgccggcggccgctcgagcaccctgcctgctcctagcggacgtgccgttcctgccgcccaggggccccgagcccgctgccccgctggctcccagccgtccgccgcctgcgctcggccgccagaagcgcagcgacagcgtctccacgtccgatgaggacagccagtctgaagacaggaatgacctaaaggcatcccccaccttgggcaagaggaagaagcggcggcacaggacagttttcactgctcaccagctggaagagttggagaaggcattcagcgaggcccactaccctgatgtgtatgcccgagaaatgctggctgtgaaaactgagctccccgaagaccggatacagtgcaaacttctgctcctggaggctcccgttcactggactttgcaggagacacacaggctccccagaccccgtggtggtgcctgatgaccttcagctgaaccctgtaatgctgctaaagtctgcccctctggagaagtgctcaggtagcattgttctgcctcaggaagcatgccgattttcctgtgtcatccttgatgatcactgctaccagacttgccccctgcagggcaccccatgtgcaaggaattcaacaacctaggagttgaaagcattggtctcccaagttcagtgtgttcttttccgtatctattaccagctgatgagaataaacctgcagtcatgacagctaggtcctagtgacaggtgcagaaagctgctcttacagaaactcccctccttattaagaggctttgtctatcactcggaactgcttctactcaagattatctgttgaaagggaactgtccataccagggcattgttctgacttttctggacttcctcaacccaaaatgccttgaagaaaaaaaaaa

SEQ ID NO: 34234 - DNA, 4773 bp, Homo sapiens
ctgcttgtcaaaaggcggcagcggagccgtgtgcgccgggagcgcggaacagcttgtccacccgccggccggaccagggctcctgaacctagcccagctggacggagaaatggactctagcctcctctgatagcctcatgccaggccccgtgcacattgctttgcttgcctccctcaatcctcatagcttctctttgggaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggcccggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaacc

SEQ ID NO: 34235 - DNA, 4762 bp, Homo sapiens
ggggacaggggtgaggccagagacggacggacgcaggggcccggcccaaggcgagggagaacagcggcactgaggcagaaaggaagagggcggtgtgttcacccgcagcccaatccatcactcagcaactcctagacgctggtagaaagttcctccgaggagcctgccatccagtcgtgcgtgcagaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggcccggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaa

SEQ ID NO: 34236 - DNA, 1782 bp, Homo sapiens
aaaaggcggcagcggagccgtgtgcgccgggagcgcggaacagcttgtccacccgccggccggaccagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggtgagccctcctcccaggctctccccagtggaaagggagggagaagaagcaaggtgtttccatgaagggagcccttgcatttttcacatctccttccttacaatgtccatggaacatgcggcgctcacagccacaggagcaggagggtcttggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggca

SEQ ID NO: 34237 - DNA, 937 bp, Homo sapiens
cggcagcggagccgtgtgcgccgggagcgcggaacagcttgtccacccgccggccggaccagggctcctgaacctagcccagctggacggagaaatggactctagcctcctctgatagcctcatgccaggccccgtgcacattgctttgcttgcctccctcaatcctcatagcttctctttgggggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggat

SEQ ID NO: 34238 - DNA, 596 bp, Homo sapiens
gggctgtctctgcttgtcaaaaggcggcagcggagccgtgtgcgccgggagcgcggaacagcttgtccacccgccggccggaccagggctcctgaacctagcccagctggacggagaaatggactctagcctcctctgatagcctcatgccaggccccgtgcacattgctttgcttgcctccctcaatcctcatagcttctctttgggaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagag

SEQ ID NO: 34239 - DNA, 3554 bp, Homo sapiens
aaaaggcggcagcggagccgtgtgcgccgggagcgcggaacagcttgtccacccgccggccggaccagaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggcccggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaa

SEQ ID NO: 34240 - DNA, 562 bp, Homo sapiens
gatgacatggcatgcctgctcccaacaagccacttctgtttgcagtcactgatctggggactaaagtccctggaaagagcctctcgtgcccacttccttagagactggggaggcggtcagcgctccgccttagataaaaggtttccccttcttcatttcagaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatg

SEQ ID NO: 34241 - DNA, 3925 bp, Homo sapiens
gtgtgcgccgggagcgcggaacagcttgtccacccgccggccggaccaggtgcgaacccgggagcagcgggaaagggggtctcaggatagggactcggggtcggggcgtctgggataccggggcctgagcgcccggctgcgagcattagagtctaagtctcagcggtaaacttggctactgaggtccgggctgtcgtgccatgaggctgggacactaaggggcactgaggtttgagaaagctgaagttcgtgccaggctggcgaggggagcagcgacatcctcggcgcttaggagaaatgctccgctaacacagtgcttagcacttgggcaacaagaagtatttgtttccttcttctgtcggggcgccttggcatggagtggaggaataagaaaaggagcgattggctgtcgatggtgctcagaactgctggagtggaggaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggcccggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaa

SEQ ID NO: 34242 - DNA, 901 bp, Homo sapiens
gcgattccgcacgtcccttacccgcttcactagtcccggcattcttcgctgttttcctaactcgcccgcttgactagcgccctggaacagccatttgggtcgtggagtgcgagcacggccggccaatcgccgagtcagagggccaggaggggcgcggccattcgccgcccggcccctgctccgtggctggttttctccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggagggaaggttctgagcaataaagtttcttagatcaatcagccaagtctgaa

SEQ ID NO: 34243 - DNA, 1012 bp, Homo sapiens
cgcgattccgcacgtcccttacccgcttcactagtcccggcattcttcgctgttttcctaactcgcccgcttgactagcgccctggaacagccatttgggtcgtggagtgcgagcacggccggccaatcgccgagtcagagggccaggaggggcgcggccattcgccgcccggcccctgctccgtggctggttttctccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccaggtggggcaggggtttcgggctggtggagcatgtgctgggacaggacagcatcctcaatcaatccaacagcatattcggttgcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggagggaaggttctgagcaataaagtttcttagatcaatcagccaagtctgaa

SEQ ID NO: 34244 - DNA, 2023 bp, Homo sapiens
caatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagtttaaaa

SEQ ID NO: 34245 - DNA, 501 bp, Homo sapiens
agaatgagatcatgtctggcctgttgcaagaaccagaatgaaggatggagcagaagttggattggggcggcaagaagggagcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacct

SEQ ID NO: 34246 - DNA, 2490 bp, Homo sapiens
acgggggcggggccgagggaccaagcggccgctcctggccggagggcggccgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcgggtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacagagaataaa

SEQ ID NO: 34247 - DNA, 2325 bp, Homo sapiens
cagaatggtcaaagaggacctcctgaggaggtgacattgggcaaagacctaaatgatgaggagtcaccatggggctagaacagtaaagagcacagcctgtgcacagctcccgcggctggaaggagccattcaaggaggcctgtggaccaatgtggagagaggaaggtggcaggtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacagag

SEQ ID NO: 34248 - DNA, 697 bp, Homo sapiens
aaacgcggaacaaggacccgagcgaaggaagcggacccgtgcgtcttcgcacggggtctgggaattctggcccgggccgccccagtcctactacccggggctgtccgtccccggctctccccggagtttcccagggcctccgccacgtgaccccagtgtttgtctcccgcccagagcccgcgcccgcagccacagggtggggcaaggtatcaaagaccccacccagctgagctaggagtgagggatgtgagccacccccgcttggcaccccggtggatctggtaacaaagtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgg

SEQ ID NO: 34249 - DNA, 2216 bp, Homo sapiens
agctgagctaggagtgagggatgtgagccacccccgcttggcaccccggtggatctggtaacaaagtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacag

SEQ ID NO: 34250 - DNA, 548 bp, Homo sapiens
ttccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcggatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccg

SEQ ID NO: 34251 - DNA, 2458 bp, Homo sapiens
cgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcgggtgaggaacgcgggaccaggaggacggtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacag

SEQ ID NO: 34252 - DNA, 2365 bp, Homo sapiens
cgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcggatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacag

SEQ ID NO: 34253 - DNA, 5035 bp, Homo sapiens
cggcggcggcggatcccgagcctggtccggcccggccttcccagtgcgctcggcccggcccgcgcaggcggcgagtcctccgagccccgggcccggacccctcgcgccggtccctgccccgcgcggcctcggagcgcgcgcggccccgccccgccccggcctcggcccgccgggcccgcagtgtgagagcgcctgctcgctgtgcccccgggttatgacgacccccaataaaggaaacaaggccttgaaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccagcatgaagctggagctcgacgcgctgcgctccaagtacgaggcgctgcagaccttcgcccggacggtggcccgcagccccgtggcgccagcccggggcccccttgccgccggcctggggcccctcgtcccaggcaaggtggccgccaccagcgtcatcacaatagtaaagtccaagacggatgcccgatcgtagggacgcgcgtctgcccaggcgggtctttgcggggccactaggcacatggcgaatttggctgccctgtccctctgtttccttctcttctctttcctccctctcttccccacccttctctcttccctgcaaagcacaacctgtaccccaggggcgccgggctgagcccctttgatctcgtcattgtcgtcgtgtgttttgtatgttgggattggtcagttcggcggtgacgtggggtcgccccaaccccttttgtaccagggccatgcaggcttggagtccagagttggtgctgtgggaacggactagagagagttgcgggagagagaaggagcaggcacgctgggcctcgcgtgtccccgagcagtgagggtcccagtgttccctccactcccgagtggccacaggctcgcgggctgggaaggattcactctctttagccccaggggagcagctcagcttagcccagcatgaagagatgggctctgctctgagagtagggcgggcttgaaggccctgatgggtggaccaccagcctgggcgcagtggtgctgggggcgtgcagctgggcccaggggctgtgcactcaggcctgacccgttgcactgaacaagaccaaatctctggttgtgcgcttaacgtgagggtgggtccagtgtgccctgcgatgggtcccgtgtcactgtttacatgacctatttgtgtggttatatagccctttatttaaaagagagaagttccttttacaaagttattaaattaattatatgtttaaaagttaaagaaaaaagagctgcagagtatttataaaactgtcttttagaaaaaaaacaagcaagaagaccatttgaccatatgaatggaaaagggaagaaagtataatagaaactttgctagttaaaaaaaaaagaaaaaaaaagaaaaaaaatccctttcttgtaaacttacggacacctctttgtggctgttggagtttagtttttatatacacagagttatcagacattatttataaaacttagtttaaaaaaaagacaaaaaaaaaaaagccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgctagtccctgaagcctttaaccaaacgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaag

SEQ ID NO: 34254 - DNA, 5030 bp, Homo sapiens
ccgcgtcttattccttctaatctctcccctgccccttgtcttgcgcctgccttcctaacagccttcagttccccttctcccgtcagaccttcctgacctcccacctggttctctaggggcagggtggacaggaagcagctcagcccagcctgggagaggccaagggctgcctcctatcagagagcgcctgctcgctgtgcccccgggttatgacgacccccaataaaggaaacaaggccttgaaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccagcatgaagctggagctcgacgcgctgcgctccaagtacgaggcgctgcagaccttcgcccggacggtggcccgcagccccgtggcgccagcccggggcccccttgccgccggcctggggcccctcgtcccaggcaaggtggccgccaccagcgtcatcacaatagtaaagtccaagacggatgcccgatcgtagggacgcgcgtctgcccaggcgggtctttgcggggccactaggcacatggcgaatttggctgccctgtccctctgtttccttctcttctctttcctccctctcttccccacccttctctcttccctgcaaagcacaacctgtaccccaggggcgccgggctgagcccctttgatctcgtcattgtcgtcgtgtgttttgtatgttgggattggtcagttcggcggtgacgtggggtcgccccaaccccttttgtaccagggccatgcaggcttggagtccagagttggtgctgtgggaacggactagagagagttgcgggagagagaaggagcaggcacgctgggcctcgcgtgtccccgagcagtgagggtcccagtgttccctccactcccgagtggccacaggctcgcgggctgggaaggattcactctctttagccccaggggagcagctcagcttagcccagcatgaagagatgggctctgctctgagagtagggcgggcttgaaggccctgatgggtggaccaccagcctgggcgcagtggtgctgggggcgtgcagctgggcccaggggctgtgcactcaggcctgacccgttgcactgaacaagaccaaatctctggttgtgcgcttaacgtgagggtgggtccagtgtgccctgcgatgggtcccgtgtcactgtttacatgacctatttgtgtggttatatagccctttatttaaaagagagaagttccttttacaaagttattaaattaattatatgtttaaaagttaaagaaaaaagagctgcagagtatttataaaactgtcttttagaaaaaaaacaagcaagaagaccatttgaccatatgaatggaaaagggaagaaagtataatagaaactttgctagttaaaaaaaaaagaaaaaaaaagaaaaaaaatccctttcttgtaaacttacggacacctctttgtggctgttggagtttagtttttatatacacagagttatcagacattatttataaaacttagtttaaaaaaaagacaaaaaaaaaaaagccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgctagtccctgaagcctttaaccaaacgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaag

SEQ ID NO: 34255 - DNA, 3368 bp, Homo sapiens
ggagccgggcgggcgggtgcggtggcggcgggcggcgcgggggcacttgttgttcttcgcgaagtcggagcccgagcgccaggcggcggcggcggccgaggggagcgcgacagtgagcgccggcgcgaggacagcgcgtgcccgcgaggagccgccgcgcgcccgcgccctccgcgcgacgccagctacgagttccagggagctctgtcctggtgaccgtgcccgggttatgacgactaatcccaaaccgaataaggcattaaaggtcaagaaggaggcgggcgagaacgccccggtgctcagcgatgatgagctggtgtccatgtcggtgcgggagctgaaccagcacctgcggggtctcaccaaggaggaggtgacccgcctgaagcagcgtcggcgcacactcaagaaccgcggctacgcggccagctgccgcatcaagcgggtgacgcagaaggaggagctggagcggcagcgcgtggagctgcagcaggaggtggagaagctggcgcgtgagaacagcagcatgcggctggagctggacgccctgcgctccaagtacgaggcgctgcagaccttcgcgcgcaccgtggcccggggacctgtggcgccctccaaggtggccaccaccagcgtcatcaccatcgtcaagtccaccgagctctcctccacctccgtgcccttctcggctgcatcctagtgccggccgggggcggggggtggcgggcggcgggcggcgggcaggcgggtgggggcacacccctcgtacctgtcactgggatgcagactctcgacatccgagtccaagcgcaggcccctcgggcgcaggcagctcacaccaggaagagactgtattgcagggtgaagagtgggctcccgtgggcccagagctgcacgccggtccacagacacactcacgcccgccacctgctccccgcaggatgtgtctgtgtgtgggaattggtatcttgcacccgtgggagtcgggacatataatggaaaggccctcgggaagttccgcgtcctctgtgggggctgccggaagacacggccccaggagtcaggcccctgtggtcaggtctagcatggggcttgttttccactcctgctgtaagcagccttcgacacctgtcctgccacggcctcccagccggtgcgggagcccctcactgccctgaccgactccgcagtccccggggaggagcatggatggtgtgtcggcagctccgtccttccagctgtcccgttgcagtgcccgtgatccgcgtctgccttagcaggggcctgcgtgagtgggcacggtgtgggaggtcgcctgcgtggggtggtgtctgtgtgtgtgcacgcacgcctgccatcaaagcagcagggctgagggggtgcagcttgctggtgttcactgggggagggcctgtgggcacacatggcagagagagtggctcacacgtcgtgaggtctcccctgtgctctggtgacccgaggaggtcgtgcagcacagcgcagaagcccctgcccacgggatccggccccccagacaccgaccccacaggccgtcccggatctcagcggacacaggcaggagcgccccatcatttgacggtgagcaggactcaggctgtgtgtcctggagctacttctcaccaactgtggtcagtgcagggggaacgaggaggtcttttgggggcctggcgaggggaagggctgctgcagtctagggagagggggtgcagcctgggggatgttggtggacatggatgtggaggtggaaggaggaggacgttgcgtggagtggtgggaggaggcgggagccgtgtgcgagagcaggtggaaagccttgaggggcaggaccaggatgcagctggcttgtagaagagctcaggagtgagcctggcactccagagggcgcggcgggtggggaggcagcaggcaccagtccaggagagcttcgtggacgtggctcctgcgcgcacacccccaggagcacagccacgggctgcaggtgtggctggcctcagcactcagtcctcacccggagcctttgcctgctcctccttccaagagcactgaggcaccagtgggcttggcactccaccttgggcttccttttcctggagagccgccttgagggtccctcctgtgactggggtctctgcagcgagagccgcgggggttgcggagcccctgcctgggggagctggcggaatgtgagccgccggccgggggccgccacataagacctgcaaggtggtgcctggggccctggctccttctcggctgcccctgcccacccagtaacagcccccaccagctacagagcccaggcgggtgccagccacgctgggagggcagaggacagacagccccggggctgcgacttggttctgtgtctactgttagaagttgagtgggaagctgcaggcccgccaggaccactgggtccctacagagcaaaggcctgcgtgttcccaaacagccgttgcccccgtggccgtggtaggtaatccatattggatgtcataaggaccagggggatatttaaagagagaaacagaaaatatatagagatataaaattatattcacagtttatctacagatttttcgtaacaatctttcttttccagtttgatactgtaaatctatcagagcagagccgggggcacgggcacaggtgggagttgggagcaaagcggaggcccgggctgcccgccgtcccccttcatctccccacggactgtaccaggcagctgggccccgcaggacaggccgcagcgggtggccggttctgtcccgtcttggggttcttggtgtccacgtcttgtgggccgtgggcttctacctgcccttggcctgcagtgctttgctggagaagggactccctggtccccagggtggacggagccgctgtcaccgcccagagctgggccggggaagcacggtgtgttctgcttttcttttcagattgttgaaatttcattgtcatgatttaatatatggatttttttatttaagaaaaagacgagggactctttgtcacgtgggtttgttttctgtctccgtgcctccggcttcccaaagagatccaggtctttgcgtttccagggcgtggggaccccggccccctatgccgccacgccgccacaccgcctcaccctggcttctgtgctacttggcagttccatttcattatttattttttgtgctgctttttatcatgatataaattattgaaaacagatcacatgtgggcccgtgtctggccgccgccgccctgccccgtccctgcggccaccacctaatttattgccgtgcgtcctgctgctgtgactgcttttgtacctttgcaataaagaattttctggtttcaga

SEQ ID NO: 34256 - DNA, 2773 bp, Homo sapiens
tttgcaggtccccacggtggcggaggcagctgggccccagcctctccactgtcaccctcaccccaggacgtggtgcgaaggagcctggagcccacctggccgtccccgggaccggctggtgccatcctgtgccatctacgtcagcgccctgagatcagctggccttggcaggggcagcggactcggcagcctggcgcaggaccctgtctcacctgtgcggccctcttgttgtgggggtttgtgggttgcgggggtggggcccccatcggaggcagggctggagggtggagggatttgggcccgagggctccctggcccagggtgtggggagggtcctgggctggcagggaggacgggatgcggtcacccgcccccatgatgcccatgtccagtggaggtgctgaccaaggacaccccccaccgccgtgtgctgctctgatgttcctgtgggaacctgtgtctggtatttggggtatgggagtgggtgctgtgaacccctgtcccgcgagctgcccggcgccttctgcccgcccgtcccggccgccgggtgcaaatgggtttgttgactgcctgccggcctcgtgatgtctgtgcaacctgacctgaagtcaggatcgcgtttgggcttctcggtttccatgacaaccgtgggggctggctcggtcccaaggtcgccatggcaactatcggagggctcatgccggggatgctttggctgggtttttcatgaatgattagaatgtgtgacacaatgcagacgtgaggacggcgggggcggcggcggggacgactcccgccagacggtcaaatgctcggcagggcggcggctcccccacctccctggtctctggctgcggcccccggacctgccgcccctcaggaaccccacacccccttgggccgcagggtcctcgctcgggggcagcttaggtggaggtggtgatgtcacagccgcagcggccagggccgtgctacgagttccagggagctctgtcctggtgaccgtgcccgggttatgacgactaatcccaaaccgaataaggcattaaaggtcaagaaggaggcgggcgagaacgccccggtgctcagcgatgatgagctggtgtccatgtcggtgcgggagctgaaccagcacctgcggggtctcaccaaggaggaggtgacccgcctgaagcagcgtcggcgcacactcaagaaccgcggctacgcggccagctgccgcatcaagcgggtgacgcagaaggaggagctggagcggcagcgcgtggagctgcagcaggaggtggagaagctggcgcgtgagaacagcagcatgcggctggagctggacgccctgcgctccaagtacgaggcgctgcagaccttcgcgcgcaccgtggcccggggacctgtggcgccctccaaggtggccaccaccagcgtcatcaccatcgtcaagtccaccgagctctcctccacctccgtgcccttctcggctgcatcctagtgccggccgggggcggggggtggcgggcggcgggcggcgggcaggcgggtgggggcacacccctcgtacctgtcactgggatgcagactctcgacatccgagtccaagcgcaggcccctcgggcgcaggcagctcacaccaggaagagactgtattgcagggtgaagagtgggctcccgtgggcccagagctgcacgccggtccacagacacactcacgcccgccacctgctccccgcaggatgtgtctgtgtgtgggaattggtatcttgcacccgtgggagtcgggacatataatggaaaggccctcgggaagttccgcgtcctctgtgggggctgccggaagacacggccccaggagtcaggcccctgtggtcaggtctagcatggggcttgttttccactcctgctgtaagcagccttcgacacctgtcctgccacggcctcccagccggtgcgggagcccctcactgccctgaccgactccgcagtccccggggaggagcatggatggtgtgtcggcagctccgtccttccagctgtcccgttgcagtgcccgtgatccgcgtctgccttagcaggggcctgcgtgagtgggcacggtgtgggaggtcgcctgcgtggggtggtgtctgtgtgtgtgcacgcacgcctgccatcaaagcagcagggctgagggggtgcagcttgctggtgttcactgggggagggcctgtgggcacacatggcagagagagtggctcacacgtcgtgaggtctcccctgtgctctggtgacccgaggaggtcgtgcagcacagcgcagaagcccctgcccacgggatccggccccccagacaccgaccccacaggccgtcccggatctcagcggacacaggcaggagcgccccatcatttgacgtttgatactgtaaatctatcagagcagagccgggggcacgggcacaggtgggagttgggagcaaagcggaggcccgggctgcccgccgtcccccttcatctccccacggactgtaccaggcagctgggccccgcaggacaggccgcagcgggtggccggttctgtcccgtcttggggttcttggtgtccacgtcttgtgggccgtgggcttctacctgcccttggcctgcagtgctttgctggagaagggactccctggtccccagggtggacggagccgctgtcaccgcccagagctgggccggggaagcacggtgtgttctgcttttcttttcagattgttgaaatttcattgtcatgatttaatatatggatttttttatttaag

SEQ ID NO: 34257 - DNA, 632 bp, Homo sapiens
ggggcaccttgtgctgtgcaggtgcagacgtcttctctgacctcagggagagtcagaacaggaagcagccactgccggcgcctgctggtcaccccacagtgccggcggctgcagcccagctacgagttccagggagctctgtcctggtgaccgtgcccgggttatgacgactaatcccaaaccgaataaggcattaaaggtcaagaaggaggcgggcgagaacgccccggtgctcagcgatgatgagctggtgtccatgtcggtgcgggagctgaaccagcacctgcggggtctcaccaaggaggaggtgacccgcctgaagcagcgtcggcgcacactcaagaaccgcggctacgcggccagctgccgcatcaagcgggtgacgcagaaggaggagctggagcggcagcgcgtggagctgcagcaggaggtggagaagctggcgcgtgagaacagcagcatgcggctggagctggacgccctgcgctccaagtacgaggcgctgcagaccttcgcgcgcaccgtggcccggggacctgtggcgccctccaaggtggccaccaccagcgtcatcaccatcgtcaagtccaccgagctctcctccacctccgtgcccttctcggctgcatcct

SEQ ID NO: 34258 - DNA, 1041 bp, Homo sapiens
atgccctcgcccctggccctacgcccctacctccggagcgagttttccccatcggtggacgcgcggccctgcagcagtccctcagagctacctgcgaagctgcttctgggggccactcttcctcgggccccgcggctgccgcgccggctggcctggtgctccattgactgggagcaggtgtgcttgctgcagaggctgggagctggagggtttggctcggtgtacaaggcgacttaccgcggtgttcctgtggccataaagcaagtgaacaagtgcaccaagaaccgactagcatctcggcggagtttctgggctgagctcaacgtagcaaggctgcgccacgataacatcgtgcgcgtggtggctgccagcacgcgcacgcccgcagggtccaatagcctagggaccatcatcatggagttcggtggcaacgtcactttacaccaagtcatctatggcgccgccggccaccctgagggggacgcaggggagcctcactgccgcactggaggacagttaagtttgggaaagtgtctcaagtactcactagatgttgtgaacggcctgctcttcctccactcgcaaagcattgtgcacttggacctgaagcccgcgaacatcttgatcagtgagcaggatgtctgtaaaattagtgacttcggttgctctgagaagttggaagatctgctgtgcttccagacaccctcttaccctctaggaggcacatacacccaccgcgccccggagctcctgaaaggagagggcgtgacgcctaaagccgacatttattcctttgccatcactctctggcaaatgactaccaagcaggcgccgtattcgggggagcggcagcacatactgtacgcggtggtggcctacgacctgcgcccgtccctctccgctgccgtcttcgaggactcgctccccgggcagcgccttggggacgtcatccagcgctgctggagacccagcgcggcgcagaggccgagcgcgcggctgcttttggtggatctcacctctttgaaagctgaactcggctga

SEQ ID NO: 34259 - DNA, 3545 bp, Homo sapiens
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcaggcaaccaaagctcagagactgttccaattttaaatgaagtctgaaattagtcagacagaaaataattgcaatgtatttgactgtcagaataagaaagtcaactgtcaatgttgtgaggccgatctgaagttgaccatctgctgtcaggttttaatatcaaaagagatttcccttgtaaccctaaagtgggtgtgtgttgatgaaatataaccaattccaaattaatcctgagccagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 34260 - DNA, 3571 bp, Homo sapiens
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgactggagtgcaatggcacgatttcggctcactgcaacctctgcctcccgggttcaagcgattctcctgcctcagtctcccgagaagctgggattacaggcacccgccaccacgcccagctaattttgaatttttagtagagacggggtttctccatgttggtcaggctggtcttgaactcctgacctcaggtgatctacccgcctcggcctcccaaagtgctaggattacaggcgtgagccaccgcgcccggccagataatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacct

SEQ ID NO: 34261 - DNA, 3672 bp, Homo sapiens
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctgattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 34262 - DNA, 3302 bp, Homo sapiens
ttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctac

SEQ ID NO: 34263 - DNA, 3304 bp, Homo sapiens
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcagacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacct

SEQ ID NO: 34264 - DNA, 1630 bp, Homo sapiens
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagagaatcgaacagatgtgcagtgccagcaccgatggcagaaagtactaaaccctgagctcatcaagggtccttggaccaaagaagaagatcagagaaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 34265 - DNA, 1824 bp, Homo sapiens
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagaaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccattatgtgggccattactgaattctgacatctttagcgactgggcagccaactgggatggctccttgtgctttgcaacatacatagttaaccaacaaagacaataaaagagaagtgatgcccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 34266 - DNA, 1818 bp, Homo sapiens
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 34267 - DNA, 2639 bp, Homo sapiens
gctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccctgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttgtgctggtctgga

SEQ ID NO: 34268 - DNA, 2432 bp, Homo sapiens
gactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggagaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccctgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctgg

SEQ ID NO: 34269 - DNA, 2602 bp, Homo sapiens
atctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatga

SEQ ID NO: 34270 - DNA, 1834 bp, Homo sapiens
atctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctg

SEQ ID NO: 34271 - DNA, 1953 bp, Homo sapiens
attagcgcagggacctccgggccacagctcagagaatcggaaggcctcctcccccttcccgagcgctgccactggggccgaggtttccagcaagaacccgcgtgtccctgcgcacgcacacacggtgcacacgtcagtccggcgcctccccgtgccccgactcacgcaggtcctcccgcgcgcccgcaacacgcccgcaggctcctgtgtctgctgccggggcagcggggcccggaaggcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctca

SEQ ID NO: 34272 - DNA, 1807 bp, Homo sapiens
gccgctcgctcggctccgctccctggctcggctccctgcctccgcgtcgcagcccccgccgtagccgcctccgagcccgccgccacatcctctgagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctca

SEQ ID NO: 34273 - DNA, 1873 bp, Homo sapiens
gtcccgggcggggcctgggggcggagcgcgccgggccgggcgcgcaggaggggaggcgggtccgcgccgccgccgtccgcgccgccccgcccttggcccagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaac

SEQ ID NO: 34274 - DNA, 931 bp, Homo sapiens
ggcagtcccaaaaagcctctcaggcacacaacccagcacagcaaggcagtcacaccaagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggag

SEQ ID NO: 34275 - DNA, 1467 bp, Homo sapiens
gctgctggagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtcgatcggatcaatcacttttctagaggaagtagcagtccctcttgtgagagcgcaaggtcattacttgtgctcctaagggcgtggacgtgctttgtggaatgaatgagctggtgtaatgagctcagattgcctgcccttaagcagcacagcattggccgaggacttgagagtcacattacaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtg

SEQ ID NO: 34276 - DNA, 1557 bp, Homo sapiens
ggcgcggcggacagccccgggggcagcggcggggtcctgtctgggagaggacagggttgcggcgggcggaacggtgtctccttcacttcgccctccagctgctggagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 34277 - DNA, 681 bp, Homo sapiens
cccaccgacggacggaggcagcccacctgcaggaccggggcgctgtcggtccacgtggccgctctggagcagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgt

SEQ ID NO: 34278 - DNA, 457 bp, Homo sapiens
gttaattggggattctgcctttggaggatcggatcaatcacttttctagaggaagtagcagtccctcttgtgagagcgcaaggtcattacttgtgctcctaagggcgtggacgtgctttgtggaatgaatgagctggtgtaatgagctcagattgcctgcccttaagcagcacagcattggccgaggacttgagagtcacattacaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacaga

SEQ ID NO: 34279 - DNA, 738 bp, Homo sapiens
aagatggccgcgctgccccgcggcccctcgcccctctctgcccgggatctccctttggccctttgaccccagcttaccgcacttcttgtccctcccgcagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaa

SEQ ID NO: 34280 - DNA, 1581 bp, Homo sapiens
tccttcacttcgccctccagctgctggagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtgatatcacaatttctggctgtagtctctttattattttcacatcagctgtcttccttaggcttggcgtggtgatgcttgtgatcccagctactcaggaggctgaggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacat

SEQ ID NO: 34281 - DNA, 1424 bp, Homo sapiens
ggcagtcccaaaaagcctctcaggcacacaacccagcacagcaaggcagtcacaccaagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatac

SEQ ID NO: 34282 - DNA, 1355 bp, Homo sapiens
agcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 34283 - DNA, 1429 bp, Homo sapiens
aggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaac

SEQ ID NO: 34284 - DNA, 580 bp, Homo sapiens
gaggctgcgcaggcgcggacggcgttggtttgaagaccttcagcgttgccctggcggagcagagacaggccctcggggtggagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtca

SEQ ID NO: 34285 - DNA, 949 bp, Homo sapiens
agcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtgatggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagattt

SEQ ID NO: 34286 - DNA, 625 bp, Homo sapiens
aggcgcggacggcgttggtttgaagaccttcagcgttgccctggcggagcagagacaggccctcggggtggagtttctttaaaaatttccattgttgtcttatacaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacac

SEQ ID NO: 34287 - DNA, 1313 bp, Homo sapiens
atggttggagacacattaaaacttctgtctccactgatgacaagatacttctttctgcttttttattctactgattcttcagacctcaatgaaaatcaacatcccctagattttgatgaaatggcttttggaaaagtaaaatcagggattagcttcctcattcagactggagttgggatcctgggaaattcctttctcctttgtttttataacttaattttgttcactggacacaagctgagacccacggacttgattctcagccaactggccttggctaactccatggtccttttctttaaagggatacctcagacaatggcagcttttggattgaaatatttgctgaatgacactggatgtaagtttgtcttttattatcacagggtgggcacaagagtttccctcagcaccatctgccttctcaatggattccaagccattaagctcaaccccagtatatgcaggtggatggagatcaagattagatccccaaggtttattgacttctgttgtctcctctgctgggccccccatgtcttgatgaatgcatctgttcttctattagtgaatggcccactgaatagcaaaaacagtagtgcaaaaaacaattatggatactgttcttacaaagcatcaaagagatttagctcattacatgcagtcttatatttttcccctgattttatgagtttgggcttcatggtctgggccagtggctccatggtcttcttcctctacagacacaagcagcaagtccaacacaatcacagcaacagactctcctgcagaccttcccaggaagccagagccacacacaccatcatggtcctggtgagctccttttttgttttctattcagtccatagttttctgacaatttggacaactgtagttgcaaacccaggccagtggatagtgaccaactctgtgttggtcgcctcatgtttcccagcacgcagcccttttgtcctcatcatgagtgatactcatatctctcagttctgttttgcctgcaggacaaggaaaacactctttcctaatctggttgtcatgccatgagtcttttctcttcatggaattcagctatttatcataactcttgctaagatttaggaaatattaactactagttatttgtgatagcaacatacacatggccagtaatgctcttgtccaggaagatctaataccagagctaaaaatgaaagtcatggatactgttacacaaagaacactctatataactgtgttaagtccttcagacaagttcaggaaatcaaaaagtttaaaaagggaattctttagagatt

SEQ ID NO: 34288 - DNA, 1686 bp, Homo sapiens
tgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggaagatgtagattccttcatgaaacagcctgggaatgagactgcagatacagtattaaagaagctggatgaacagtaccagaagtataagtttatggaactcaaccttgctcaaaagaaaagaaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaaatgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaacta

SEQ ID NO: 34289 - DNA, 944 bp, Homo sapiens
attactcagcttttcatctgctgtgttgaaagccaacttatcatttttcacattattgtatacatctaaaagacatcataaacgaagactggaagtgaaaactgaaaaactgagaaagttttatttgttggaggttccaactccattgggagctccttctctaatggcacctcaacccatgattcatacccagcaaggcctaaggaccagtagtccttccactccatccccagagcatcaggaagatgtagattccttcatgaaacagcctgggaatgagactgcagatacagtattaaagaagctggatgaacagtaccagaagtataagtttatggaactcaaccttgctcaaaagaaaagaaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaaatgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaa

SEQ ID NO: 34290 - DNA, 4264 bp, Homo sapiens
tgtccctgcgtgtcggggtccgctcgtgcgcgcctctccggggtctgtgcgcgtggccctccgctcgcgccggagggcgtgggcgtggcctcggcgtgggtgtggccgctcggggaggggcctcccgggggcggggccggcctggtccgcgcggtgacgcgccctgcagccccgagcgagcgagcgagcgagcgagttgccgagcgcgccccgtccctcgcgcgcgatgctcccctggacggcgctcggcctggccctgagcttgcggctggcgctggcgcggagcggcgcggagcgcggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccgagcctgcagtctcgctaggatgctttactcctccacaaacagcagccgccgacaggacagcttgtgaacgtctccgccttttggggtgtccggggagaggaggtggagctgtcccctcccagtgtcaggcctccttggtcctcatgtgcaccttttattcagagagcttgggcccccttcctttggagctgggcccagggcaggtggctggaatgcagaggacaagggggctggggcctctgcagggccattcccaccgcagtctctgccacggcccggagccctgggcccagggccacgcgggctccctctgctggcaaagccacaccctgcaccgcatggggtccactgcccctttccccacgtggactctgcgtgaccccaggaactgcagcattgaggtggtctcagtccctccctcaggtctggtgggcattgtgccaggggccaccttcgggacagctggccttggcaccgtctcccaagaacccagctctgtgcatcccgtggccccaccagaaacccaaggccacaccgcccaccagctgggtgtggtcaccattcatggagggccggctggggccaggctcaccacgcagagtttgccctccggtgtgatgatgcatgagacacagtaggcccccctgcctgtgtgtgcagggggtgtctgtgggggggccctgctggctggactttgggtttctcctgagctccccttagcccccaagtcaggccacggaggcctgagtaggacccatgggctgtgtgtgtcactgcaggtggcgtgctcacaactgcactgctggtcggcaggtggccagggttgcaggcccgggcctcgggccccacctcctctggaggggtaggatctccttcgtgcagcccctgccccctaccctgttctccggagtgttggcagatctgagcccacggtcacgtgagaggagatgcctcttgcacactgagcccaggcccagctcacggagcaccctgcaggtggcagcggggcaccaggggctcattcctggtggcctcagtggcttctgtggacgactcagactcacatgagaagctgggaggagctccagctctgcaatcccgagagggcagagcgggggccctggccacaaccctgctccccacatacccgtctggcagaggctctgcctcccctctgcccatctctgcacaccaaggctgagcacagcacaaggcctcacggagagggtgaaaaggcactgccgtctccatctcagtgccaaggaatgcccctttcagaagccctcgtctgagaagtgctgccccttatgtagccccaggcattttaaaatctttgaatctgcaccaagtctcagaacagctctggccccggagtgctccgtccaggccgctgtgaaccggctgtccccgcgtctcctccacctcccctgacacaatcctggccccgactcagtccacccagggtgcagtgcagaggctgatacccgccaggacttccttgccaagggcccggccacgtcacaaggccactgcacgcttttcgacatgcacctggaaatcgggaagggccatgctgcagttgcttctagttgagacgagaagagcgacaaggttgtgatccacgtggcaggtgttcagaaggctgggggcgggcagcgctggggagagccctgggtacttcgaggagaccccgaagggaggctgctcccacacctgcgccagtttccaccctctctgtgagcagggctgcggtcacctcccacatctgaagagaaccaacctgaggatttcacgctggctgcgtgccagaccagtccctgacaggttgtgcgaggcccttcgctggacagcccattgctggccactggacggagaggcagagggggctgaaattcgggcccatgcctctgtgagcgatgacggagcaacagctctccagcacgtgaagctctccagacagctgttcgtgagaagccagacagaggcctggggtctcagtccagatttctggggagtggggtgtccaagcgtgggccacgctgctgggagccacctagggaagcaggtcgcctgtttctatagtgacggtaataaaccaagtcaattttctatagtga

SEQ ID NO: 34291 - DNA, 4511 bp, Homo sapiens
gcgcggtgacgcgccctgcagccccgagcgagcgagcgagcgagcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccgagcctgcagtctcgctaggatgctttactcctccacaaacagcagccgccgacaggacagcttgtgaacgtctccgccttttggggtgtccggggagaggaggtggagctgtcccctcccagtgtcaggcctccttggtcctcatgtgcaccttttattcagagagcttgggcccccttcctttggagctgggcccagggcaggtggctggaatgcagaggacaagggggctggggcctctgcagggccattcccaccgcagtctctgccacggcccggagccctgggcccagggccacgcgggctccctctgctggcaaagccacaccctgcaccgcatggggtccactgcccctttccccacgtggactctgcgtgaccccaggaactgcagcattgaggtggtctcagtccctccctcaggtctggtgggcattgtgccaggggccaccttcgggacagctggccttggcaccgtctcccaagaacccagctctgtgcatcccgtggccccaccagaaacccaaggccacaccgcccaccagctgggtgtggtcaccattcatggagggccggctggggccaggctcaccacgcagagtttgccctccggtgtgatgatgcatgagacacagtaggcccccctgcctgtgtgtgcagggggtgtctgtgggggggccctgctggctggactttgggtttctcctgagctccccttagcccccaagtcaggccacggaggcctgagtaggacccatgggctgtgtgtgtcactgcaggtggcgtgctcacaactgcactgctggtcggcaggtggccagggttgcaggcccgggcctcgggccccacctcctctggaggggtaggatctccttcgtgcagcccctgccccctaccctgttctccggagtgttggcagatctgagcccacggtcacgtgagaggagatgcctcttgcacactgagcccaggcccagctcacggagcaccctgcaggtggcagcggggcaccaggggctcattcctggtggcctcagtggcttctgtggacgactcagactcacatgagaagctgggaggagctccagctctgcaatcccgagagggcagagcgggggccctggccacaaccctgctccccacatacccgtctggcagaggctctgcctcccctctgcccatctctgcacaccaaggctgagcacagcacaaggcctcacggagagggtgaaaaggcactgccgtctccatctcagtgccaaggaatgcccctttcagaagccctcgtctgagaagtgctgccccttatgtagccccaggcattttaaaatctttgaatctgcaccaagtctcagaacagctctggccccggagtgctccgtccaggccgctgtgaaccggctgtccccgcgtctcctccacctcccctgacacaatcctggccccgactcagtccacccagggtgcagtgcagaggctgatacccgccaggacttccttgccaagggcccggccacgtcacaaggccactgcacgcttttcgacatgcacctggaaatcgggaagggccatgctgcagttgcttctagttgagacgagaagagcgacaaggttgtgatccacgtggcaggtgttcagaaggctgggggcgggcagcgctggggagagccctgggtacttcgaggagaccccgaagggaggctgctcccacacctgcgccagtttccaccctctctgtgagcagggctgcggtcacctcccacatctgaagagaaccaacctgaggatttcacgctggctgcgtgccagaccagtccctgacaggttgtgcgaggcccttcgctggacagcccattgctggccactggacggagaggcagagggggctgaaattcgggcccatgcctctgtgagcgatgacggagcaacagctctccagcacgtgaagctctccagacagctgttcgtgagaagccagacagaggcctggggtctcagtccagatttctggggagtggggtgtccaagcgtgggccacgctgctgggagccacctagggaagcaggtcgcctgtttctatagtgacggtaataaaccaagtcaattttctatagtga

SEQ ID NO: 34292 - DNA, 2147 bp, Homo sapiens
tgtccctgcgtgtcggggtccgctcgtgcgcgcctctccggggtctgtgcgcgtggccctccgctcgcgccggagggcgtgggcgtggcctcggcgtgggtgtggccgctcggggaggggcctcccgggggcggggccggcctggtccgcgcggtgacgcgccctgcagccccgagcgagcgagcgagcgagcgagttgccgagcgcgccccgtccctcgcgcgcgatgctcccctggacggcgctcggcctggccctgagcttgcggctggcgctggcgcggagcggcgcggagcgcggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccg

SEQ ID NO: 34293 - DNA, 1891 bp, Homo sapiens
ggtgccactcgcgcgccggccgcgctccgggcttctcttttccctccgacgcgccacggctgcccagacattccggctgccgggtctggagagctccccgaacccctccgcggagaggagcgaggcggcgccagggtggcccccggggcgcgcttggtctcggagaagcggggacgaggccggaggatgagcgactgagggcgacgcgggcactgacgcgagttggggccgcgactaccggcagctgacagcgcgatgagcgactccccagagacgccctagcccggtgtgcgcgccaggcggagcgcgcaggtggggctgggctgttagtggtccgccccacgcgggtcgccggccggcccaggatgggcgctggcaacccgggcccgcgcccgccgctgctacccctgcgcccgctgcgagcccggcgtccggcccgcgccctgcgctcatggacggcggctcccggctggcggcggcgcgcccccgggctgtgaatgcgactcgcccctcggccgcgctccccgcccgcccgcccgccgggacgtggtaggggatgcccagctccactgcgatggcagttggcgcgctctccagttccctcctggtcacctgctgcctgatggtggctctgtgcagtccgagcatcccgctggagaagctggcccaggcaccagagcagccgggccaggagaagcgtgagcacgcctctcgggacggcccggggcgggtgaacgagctcgggcgcccggcgagggacgagggcggcagcggccgggactggaagagcaagagcggccgtgggctcgccggccgtgagccgtggagcaagctgaagcaggcctgggtctcccagggcgggggcgccaaggccggggatctgcaggtccggccccgcggggacaccccgcaggcggaagccctggccgcagccgcccaggacgcgattggcccggaactcgcgcccacgcccgagccacccgaggagtacgtgtacccggactaccgtggcaagggctgcgtggacgagagcggcttcgtgtacgcgatcggggagaagttcgcgccgggcccctcggcctgcccgtgcctgtgcaccgaggaggggccgctgtgcgcgcagcccgagtgcccgaggctgcacccgcgctgcatccacgtcgacacgagccagtgctgcccgcagtgcaaggagaggaagaactactgcgagttccggggcaagacctatcagactttggaggagttcgtggtgtctccatgcgagaggtgtcgctgtgaagccaacggtgaggtgctatgcacagtgtcagcgtgtccccagacggagtgtgtggaccctgtgtacgagcctgatcagtgctgtcccatctgcaaaaatggtccaaactgctttgcagaaaccgcggtgatccctgctggcagagaagtgaagactgacgagtgcaccatatgccactgtacttatgaggaaggcacatggagaatcgagcggcaggccatgtgcacgagacatgaatgcaggcaaatgtagacgcttcccagaacacaaactctgactttttctagaacattttactgatgtgaacattctagatgactctgggaactatcagtcaaagaagacttttgatgaggaataatggaaaattgttggtacttttccttttcttgataacagttactacaacagaaggaaatggatatatttcaaaacatcaacaagaactttgggcataaaatccttctctaaataaatgtgctattttcacagtaagtacacaaaagtacactattatatatcaaatgtatttctataatccctccattagagagcttatataagtgttttctatagatgcagattaaaaatgctgtgttgtcaaccgtc

SEQ ID NO: 34294 - DNA, 1284 bp, Homo sapiens
gcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaata

SEQ ID NO: 34295 - DNA, 3287 bp, Homo sapiens
agacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgtaacagtaggattagcaattttcatttattccttccatatatatttactgaatggctactatatgcctggtattgttctttgaaagcagaaacagcaggaaaaaaagtccctccctcatagagtttacattctaaaagggaggaaatagataataaaatatacattacatttaa

SEQ ID NO: 34296 - DNA, 3234 bp, Homo sapiens
gagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtaaagaatggggagactcctcaagcaggccctgttggttgaagaagataatgatattgaagaaaatgaagatgctggagcagcctctctgcccactcagccaactcagccatcatcatcttcaacttatgacccaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgtaacagtaggattagcaattttcatttattccttccatatatatttactgaatggctactatatgcctggtattgttctttgaaagcagaaacagcaggaaaaaaagtccctccctcatagagtttacattctaaaagggaggaaatagataataaaatatacattacattt

SEQ ID NO: 34297 - DNA, 1383 bp, Homo sapiens
gtaggaagtggtgagttcggagtagagatggccgcgcttgcaccgctgcccccgctccccgcacagttcaagagcatacagcatcatctgaggacggctcaggagcatgacaagcgagaccctgtggtggcttattactctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaat

SEQ ID NO: 34298 - DNA, 2880 bp, Homo sapiens
aggcccatgatcaccctcctctcagcccacggacaggaagtcgctccccagctgccccgccccgctccccagcgccccggaagtgatctgtggcggctgctgcagagccgccaggaggagggtggatctccccagagcaaagcgtcggagtcctcctcctccttctcctcctcctcctcctcctcctccagccgcccaggctcccccgccacccgtcagactcctccttcgaccgctcccggcgcggggccttccaggcgacaaggaccgagtaccctccggccggagccacgcagccgcggcttccggagccctcggggcggcggactggctcgcggtgcagattcttcttaatcctttggtgaaaactgagacacaaaatggctgcaaataagcccaagggtcagaattctttggctttacacaaagtcatcatggtgggcagtggtggcgtgggcaagtcagctctgactctacagttcatgtacgatgagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatcctttgcagctacagctgacttcagggagcagattttaagagtaaaagaagatgagaatgttccatttctactggttggtaacaaatcagatttagaagataaaagacaggtttctgtagaagaggcaaaaaacagagctgagcagtggaatgttaactacgtggaaacatctgctaaaacacgagctaatgttgacaaggtattttttgatttaatgagagaaattcgagcgagaaagatggaagacagcaaagaaaagaatggaaaaaagaagaggaaaagtttagccaagagaatcagagaaagatgctgcattttataatcaaagcccaaactcctttcttatcttgaccatactaataaatataatttataagcattgccattgaaggcttaattgactgaaattactttaacattttggaaattgttgtatatcactaaaagcatgaattggaactgcaatgaaagtcaaatttactttaaaaagaaattaatatggcttcaccaagaagcaaagttcaacttatttcataattgcctacatttatcatggtcctgaatgtagcgtgtaagcttgtgtttcttgggcagtctttcttgaaattgaagaggtgaaatgggggtggggagtgggaggaaaggtgacttcctctggtgtttattataaagcttaaattttatatcattttaaaatgtcttggtcttctactgccttgaaaaatgacaattgtgaacatgatagttaaactaccactttttttaaccattattatgcaaaatttagaagaaaagttattggcatggttgttgcatatagttaaactgagagtaattcatctgtgaatctgctttaattacctggtgagtaacttagaaaagtggtgtaaacttgtacatggaattttttgaatatgccttaatttagaaactgaaaaatatctggttatatcattctgggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgattttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttttaaaatgtt

SEQ ID NO: 34299 - DNA, 882 bp, Homo sapiens
ggtgtgtccgggcggcggcgggccgaggccctgacgcgggttcgggctgccgagattgcacatcccacgttctgcccggggacgagctgcgagatgagcccggctggaatccggggcaccgcgttcgccgctgtggggcgagtgagcccccgagagtgagcggctgcggagaggtcccctgcgcccggcagccggtctcagttggcctcgtccgaaggtcaccccgcacctttcgtccacggcgcccaagttcccgcccgggcggtgcccgcgacctggggcaacccgctgccgccgcagtccccgcgcctcactccacccctctcccctccttccctttctttccactccttgcctgtgctagagccgctgctttttaagcatctccgccagggttttttgtttgtttgttttgtttgtttgtgtttttttttttttttgccagttaaaggaatggtttttcagacttaaagtcattagactctccgcactgaactgaatacctggccttgggcgcttgcacagctttagcccattttcagattcttcttaatcctttggtgaaaactgagacacaaaatggctgcaaataagcccaagggtcagaattctttggctttacacaaagtcatcatggtgggcagtggtggcgtgggcaagtcagctctgactctacagttcatgtacgatgagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatccttt

SEQ ID NO: 34300 - DNA, 2339 bp, Homo sapiens
gtggcttccgaggagagggcaagaacggaagcgagggcgcgctctcgagaggaggggttgcctaggcgacgccggaggcgcgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctgctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactctgtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaataaaaaagcagacaaata

SEQ ID NO: 34301 - DNA, 2308 bp, Homo sapiens
aaagcgagcccggcagctcaatgacaaatcggtggaggacggctggggtccggccccgggagggggcggggcgcgtttaagagctgcgggccgggtgcggacggcggaggcggcgggactggtccctgctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgaatgtttcaaaatcattggcatatgacaagaaaaagtatacagcaaacaaaaaagtagaaggtattctagagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactctgtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaataaaaaagcagacaaatag

SEQ ID NO: 34302 - DNA, 981 bp, Homo sapiens
ctcccgctcgggaccgtccacttcctcagtcctccggccgcggcttgggcagggtcagggctgggaagtgttgcaaaaacttaactgccctcggaacttgcacgcgccgtgaactgggcggtgttcctaaagggcttcggtttgctggttttgttttggtcctgtcttgcaaatgagcataaagttgtttctcccccagcctcctcccctttcctttctgataggggccagcggcgaaggggcttctaaggggaagcgcctggactgggcatcgccgtcccggttcttgccgcctgtgggagtgtgaggttaaccgtgctcggtgcagggttgcggggcgcggagcttgctgcgtccacactgcttgtgtgagcagtgtcctctctgtgctcatttccaacgagaaacgttggaactttggtgttcttatcagctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaag

SEQ ID NO: 34303 - DNA, 1252 bp, Homo sapiens
agaggaggggttgcctaggcgacgccggaggcgcgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctgcagctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactctgtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggag

SEQ ID NO: 34304 - DNA, 1583 bp, Homo sapiens
gatttcagcagcgggagagcgggtggcaggaggaggtctctgcatgaaacagcggcagtcagctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactctgtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagt

SEQ ID NO: 34305 - DNA, 3155 bp, Homo sapiens
agccgcgggaaattcccctcccgccaggctgctcgcctctcggctgggccagcactcggctctccccgctccgccccctgcccctggctcccgtacggtggacggcgacgctgggtgacccggggtgcaagaattcaggggttgggaaggtgtgagccgcaaacccagcggagggcgggaagaaggaggaggcctctagggtggtcgggggactgggggccccgccggcagaggtccctcggcctcctgactgactgactgcggccgcctccggccaggacgctgggagctgcctgcgggaaggtgcggggagcggagccatggcctccggtgcgtataacccgtatatagagataattgaacaacccaggcagaggggaatgcgttttagatacaaatgtgaagggcgatcagcaggcagcattccaggggagcacagcacagacaacaaccgaacatacccttctatccagattatgaactattatggaaaaggaaaagtgagaattacattagtaacaaagaatgacccatataaacctcatcctcatgatttagttggaaaagactgcagagacggctactatgaagcagaatttggacaagaacgcagacctttgtttttccaaaatttgggtattcgatgtgtgaagaaaaaagaagtaaaagaagctattattacaagaataaaggcaggaatcaatccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttttccagaaactgtgccaggatcacgtagaaacagggtttcgccatgttgaccaggatggtcttgaactcctgacatcaggtgatccacccaccttggcctcccaaagtgctgggattacagttaattttcctgagagaccaagacctggtctcctcggttcaattggagaaggaagatacttcaaaaaagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataacttgcaagatttaaatccttttaaatcttgataccacctatatagatgcagcattttgtatttgtctaactggggatataatactatatttatactgtatatataatactgactgagaatataatactgtatttgagaatataaaaaacttttttcagggaagaagcatacaactttggacatagcgaatacaaaattggaagctgtcataaaaagacaactcagaggccaggcgcaggggctcacacctgtaatcctagcactttgggaggccaaggcgggtggatcacttgagaccaggaattcgagaccagcctggccaacatggtgaaaccccgtctctactaaaaatacaaaaattagctgagcatggtggtacgtgcctgtactgtcagctacttgggaggctgaggcacaataattgtttgaacccaggaagcagaggttgcagtgagctgagatcacaccaccgcactccagcctgggtgacagagtgagactctgtctcaaaaaaaaaaaaacaaaaaaaacacacttttttatatttctttttataatgttttaatgtattcttaaatttcaagcaaatttaagataaaacttgtaatggctatgccattgaaaaacttaattttttatttttgaggcccatgggccaaggtaacccctaaggggttttcttaggcttcttggagcttagatttgtatgtatatcaaaatgtctttaaaatgttaagttgggcagaaggcagttgaagtgagctttcaaggtatgggaggttttctacattttatactatttcaatctatgcctttaaagttgcttatgattttagctgtacactcattttttaaggggaagaagtttccttggaccattcgcctttcttagatgtcctcactccctgtgatctcataaaactgcctatttgacatctctatctagaaatctaattaaagctcacactcagcata

SEQ ID NO: 34306 - DNA, 2398 bp, Homo sapiens
caggggttgggaaggtgtgagccgcaaacccagcggagggcgggaagaaggaggaggcctctagggtggtcgggggactgggggccccgccggcagaggtccctcggcctcctgactgactgactgcggccgcctccggccaggacgctgggagctgcctgcgggaaggtgcggggagcggagccatggcctccggtgcgtataacccgtatatagagataattgaacaacccaggcagaggggaatgcgttttagatacaaatgtgaagggcgatcagcaggcagcattccaggggagcacagcacagacaacaaccgaacatacccttctatccagattatgaactattatggaaaaggaaaagtgagaattacattagtaacaaagaatgacccatataaacctcatcctcatgatttagttggaaaagactgcagagacggctactatgaagcagaatttggacaagaacgcagacctttgtttttccaaaatttgggtattcgatgtgtgaagaaaaaagaagtaaaagaagctattattacaagaataaaggcaggaatcaatccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttttccagaaactgtgccaggatcacgttaattttcctgagagaccaagacctggtctcctcggttcaattggagaaggaagatacttcaaaaaagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataacttgcaagatttaaatccttttaaatcttgataccacctatatagatgcagcattttgtatttgtctaactggggatataatactatatttatactgtatatataatactgactgagaatataatactgtatttgagaatataaaaaacttttttcagggaagaagcatacaactttggacatagcgaatacaaaattggaagctgtcataaaaagacaactcagaggccaggcgcaggggctcacacctgtaatcctagcactttgggaggccaaggcgggtggatcacttgagaccaggaattcgagaccagcctggccaacatggtgaaaccccgtctctactaaaaatacaaaaattagctgagcatggtggtacgtgcctgtactgtcagctacttgggaggctgaggcacaataattgtttgaacccaggaagcagaggttgc

SEQ ID NO: 34307 - DNA, 2681 bp, Homo sapiens
cgtcctcggcgaggcgcgcacttggccccgacccccggcagcggctgtgcgtgcagcctcttcgtcctccgcgcggcgtgcacttgctcccggcccctgcgccgggcggcggcggggcagcgcgcaggcgcggccggattccgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 34308 - DNA, 2700 bp, Homo sapiens
tcttcgtcctcggcgaggcgcgcacttggccccgacccccggcagcggctgtgcgtgcagcctcttcgtcctccgcgcggcgtgcacttgctcccggcccctgcgccgggcggcggcggggcagcgcgcaggcgcggccggattccgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctggctaga

SEQ ID NO: 34309 - DNA, 2163 bp, Homo sapiens
ggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 34310 - DNA, 3183 bp, Homo sapiens
ctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccaggtaaggatttccttttgtcccactggaacgacaggttcagctctgttcagctgaggagcagtggagatgaagactcctgggccccattacagacctactgaatcagaggctttgaaaggatggcgcaggaaccagcgacttcctgggatgctaatgcacactgaagcctgggaaccaccgtgccacttaaattctatattgggtatcttgggaatcagaagttaaaaatgcagaatctctgctctcatctctcacttgaattgggggaacaaaaatcacctctaaattagcaagatgtgtgtgcctgtgcgaggctcaaaaactgacaagctctgcacttcaggccgctgctcacttggtgctccatgggctcattgcctctcaggacttagtttttcagctgtaaactgaggagtccagcttatctctccaagtgtcccttcctctaaaaggctggaagagtttcgtgggcttgagtagtcagggaggactccaaggtggaggtgtggctagaactggaccctacaggctgggtcagatggggtaagaggaaggagatagggtgttggcagtgactccctagagagggattgagcctgagcaccatgaagaggggctggggtacagaggacggggtggatctctagggctttctctgacccctgcctctctgtctctctcctccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctgg

SEQ ID NO: 34311 - DNA, 1113 bp, Homo sapiens
ctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccagaggccccccgacccagc

SEQ ID NO: 34312 - DNA, 1437 bp, Homo sapiens
gcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaaggtttggatgtctgggcctctgtactttggacagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagagcactgggttgcaggggattgaagccctccaaaagcacttacggattctggtggggtgtgttccaactgcccccaactttgtggatgtcttcctt

SEQ ID NO: 34313 - DNA, 2287 bp, Homo sapiens
cccgcccggcccggccccgcgccccgcgcagccccgggcgccgcgcgtcctgcccggcctgcggccccagcccttgcgccgctcgtccgacccgcgatcgtccaccagaccgtgcctcccggccgcccggccggcccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacagatgaattggagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatccttggggagagcagcaccgaggccagcaagacgctgcccgccatcgagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacagttttaacaacctgggcatccagtgtgtgaggaagaaggagattgaggctgccattgagcggaagattcaactgggcattgacccctacaacgctgggtccctgaagaaccatcaggaagtagacatgaatgtggtgaggatctgcttccaggcctcatatcgggaccagcagggacagatgcgccggatggatcctgtgctttccgagcccgtctatgacaagaaatccacaaacacatcagagctgcggatttgccgaattaacaaggaaagcgggccgtgcaccggtggcgaggagctctacttgctctgcgacaaggtgcagaaagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatgacagctacggcgtggacaagaagcggaaacgggggatgcccgacgtccttggggagctgaacagctctgacccccatggcatcgagagcaaacggcggaagaaaaagccggccatcctggaccacttcctgcccaaccacggctcaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgaaggtggggggtaggttggttgttcagagtcttcccaataaagatgagtttttgagcctc

SEQ ID NO: 34314 - DNA, 2219 bp, Homo sapiens
cgcgcagccccgggcgccgcgcgtcctgcccggcctgcggccccagcccttgcgccgctcgtccgacccgcgatcgtccaccagaccgtgcctcccggccgcccggccggcccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacagagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatccttggggagagcagcaccgaggccagcaagacgctgcccgccatcgagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacagttttaacaacctgggcatccagtgtgtgaggaagaaggagattgaggctgccattgagcggaagattcaactgggcattgacccctacaacgctgggtccctgaagaaccatcaggaagtagacatgaatgtggtgaggatctgcttccaggcctcatatcgggaccagcagggacagatgcgccggatggatcctgtgctttccgagcccgtctatgacaagaaatccacaaacacatcagagctgcggatttgccgaattaacaaggaaagcgggccgtgcaccggtggcgaggagctctacttgctctgcgacaaggtgcagaaagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatgacagctacggcgtggacaagaagcggaaacgggggatgcccgacgtccttggggagctgaacagctctgacccccatggcatcgagagcaaacggcggaagaaaaagccggccatcctggaccacttcctgcccaaccacggctcaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgaaggtggggggtaggttggttgttc

SEQ ID NO: 34315 - DNA, 2270 bp, Homo sapiens
cgcgccccgcgcagccccgggcgccgcgcgtcctgcccggcctgcggccccagcccttgcgccgctcgtccgacccgcgatcgtccaccagaccgtgcctcccggccgcccggccggcccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacagatgaattggagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatccttggggagagcagcaccgaggccagcaagacgctgcccgccatcgagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacagttttaacaacctgggcatccagtgtgtgaggaagaaggagattgaggctgccattgagcggaagattcaactgggcattgacccctacaacgctgggtccctgaagaaccatcaggaagtagacatgaatgtggtgaggatctgcttccaggcctcatatcgggaccagcagggacagatgcgccggatggatcctgtgctttccgagcccgtctatgacaagaaatccacaaacacatcagagctgcggatttgccgaattaacaaggaaagcgggccgtgcaccggtggcgaggagctctacttgctctgcgacaaggtgcagaaagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatgacagctacggcgtggacaagaagcggaaacgggggatgcccgacgtccttggggagctgaacagctctgacccccatggcatcgagagcaaacggcggaagaaaaagccggccatcctggaccacttcctgcccaaccacggctcaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgaaggtggggggtaggttggttgttcagagtcttcccaataaagatgagtttttgagcctc

SEQ ID NO: 34316 - DNA, 5613 bp, Homo sapiens
cggggcggcggcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccggcgccggtgcccgcagccaccgagccgccgcccgtgctgcacctgcccgccatccagccgccgccgcccgtgctgcccgggcccttcttcatgccgtccgaccgctccaccgagcgctgcgagaccgtactggaaggcgagaccatctcgtgcttcgtggtgggaggcgagaagcgcctgtgtctgccgcagattctcaactcggtgctgcgcgacttctcgctgcagcagatcaacgcggtgtgcgacgagctccacatctactgctcgcgctgcacggccgaccagctggagatcctcaaagtcatgggcatcctgcccttctcggcgccctcgtgcgggctcatcaccaagacggacgccgagcgcctgtgcaacgcgctgctctacggcggcgcctacccgccgccctgcaagaaggagctggccgccagcctggcgctgggcctggagctcagcgagcgcagcgtccgcgtgtaccacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctcggccgctgcctggacgacgtgaaggagaaattcgactatggcaacaagtacaagcggcgggtgccccgggtctcctctgagcctccggcctccataagacccaaaacagatgacacctcttcccagtcccccgcgccttccgaaaaggacaagccgtccagctggctgcggaccttggccggctcttccaataagagcctgggctgtgttcaccctcgccagcgcctctctgctttccgaccctggtcccccgcagtgtcagcgagtgagaaagagctctccccacacctcccggccctcatccgagacagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaattcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttcagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgaggggacggtcttcggctcctctgcaccccgtgattctgcccacgctcctccaccacgaggcactgacctgcgtcgggtggtgaccgtggctggcggtcacgccctcagcccctccgggcacacgtgccgcctgaccgggcgacccttttcagttcggcaaacgtcgctcccttcattttgggactgaggctgcagcattggaacaaaagagcattatttcaatttttctttctttttttttgttcgttcatttaaacgtatatttagaactgcactttgtccacaaccttcccttctctttctattccccagtgaactgaggtttttaccgatttatagagcagtcaaatccgaagtgctcgagtgcttagaaaccccctctggtgcttggttgaacaagggaatcacaagaaaacgaaaatgcaaaaactgaacttcgggggtcgttctgtgccttccagcatcttgtacagcaaatcctgactcgtgtctttttacccccaagatatctgtcttcagtagcgactgaatctgccactctcagaataagttccttgcatttattccaaataatctcgtttactctcacctgtttatgcaaattgtataaggtttcttatgcccaagcttgaaaaatgatttcccagtagacaagaggcggctacctatcctacagttacggtatttatttacataagaagatcttacaggagttctttgcttgaatccgttctaacacccgcggcagctgcacgcgctcacagaaggtggaggttacttgcccaggtacagacgacctcggggcagtgacgagcaaagaccagagactgctgagccctcgcatctgggtggcggaattgcctgcggggttttgcccttggtttactgaggggggtcttggttgctgctgaagccccccaccccttctaaagtgcaatgcaaaagggacatcatgtatatgcagcgtttgtttggaattttctttgcttttgttttctttgcggttgttctgtgtgcatggattccacacctctgccgtaggtagatccgtcagcgggcattattaccgtgtcttgtaaagggtcggttttgttatgcaacatgcagaatgctgtttttagccttgttttaccagagttgttttttttttcagttatttcttcaagggaaactaaatgatttagttggagcaaagctttaagtgtgttggcgtgcttctgtgtggctgtcctgtgtcgccaggtcgaagatcacagtgaggtagaggccctgccccatccccagggccgccaggcttgctccgtttgctttgagtttttagaccccagagggagatgagcttttccaagctgtgtctgggccagagcctctccttgcccttgctccatcccgacggtcaccgttgggtccacgcctccaccgccccatcttgccccaaacggaaagcgctgtatctgcagtggcagcccttccccacttcggctctgggagggtccagccagtgtcacctgggcccaccctttcctgcagctgccaggcccgtgcggtcagtgggacccggacgtgggcaggcgagctcgggaccctcccaggcagttcccacagctcttgcctcggctcaccagggtcacttccactgtcaggggcctgagggggcagctgtggctgcagggctgctctggactgaggggtcccaggccccgaggggtgcacgcctggctccccttggcacaggtgcgagtccgtttcttttcagcagaagggggaagaggtgtccgctgtgtgggctgctgactcctctgtgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttcttacctgagagttgtcttgttttctgggctgtttttaactgaggaaaaaaaaaatgctttcctgccggggggcaggggagacggagaaacccatgtgcgtttcccatgtgaccccctcctccctgtgggtctgagccccggccccccccacctcctcctccctgtgggtccgaaccccggcccccccaccccctcctccctgtgggtccgaaccccggcccccccaccccctcctccctgtgggtccgatccccggccccccccaccccctcctccctgtgggtccgaaccccggccccccccccaccccctcctccctgtgggtccgaaccccggcccccccacccctccctcagcccaccagggtccagggagatgttcgttctcgctttaagtcaggagtcacaaatgacttttttttttcaattaaggaaaaagctccatctctacctttaacatcacccagacccccgcccctgcccgtgccccacgctgctgctaacgacagtatgatgcttactctgctactcggaaactatttttatgtaattaatgtatgctttcttgtttataaatgcctgatttaaaaagaaaa

SEQ ID NO: 34317 - DNA, 4685 bp, Homo sapiens
ggaggaggtggagagtgaggccgaggcgtggggagcccgggaactccctcctcctgaagtaacgcgtcccgggccggctctgccgtcgttgctgccgccgggcgccccgggacgaggaggtggaggagggagagggcccgcgggcctcgcctccgccctccgccacctcgagctgcggtagcagcgactcatgagagcgcggccggaggacagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtattagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatagtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattgaa

SEQ ID NO: 34318 - DNA, 4767 bp, Homo sapiens
ggaggaggtggagagtgaggccgaggcgtggggagcccgggaactccctcctcctgaagtaacgcgtcccgggccggctctgccgtcgttgctgccgccgggcgccccgggacgaggaggtggaggagggagagggcccgcgggcctcgcctccgccctccgccacctcgagctgcggtagcagcgactcatgagagcgcggccggaggacaggctgtggaagagagccaccattatcaaaatgatcacagttgcaaacattcgtgcttcaaataccagccactatgttagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtattagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatagtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattgaactca

SEQ ID NO: 34319 - DNA, 4639 bp, Homo sapiens
ggtcgggagaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtattagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatagtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattgaactca

SEQ ID NO: 34320 - DNA, 2297 bp, Homo sapiens
tcggccgagcccagagacagccagttcctctcccgccgcgccgggccgcgctgccgctcgctccccggccgtggcgcctccgggccagacgcgctgcagcctccagcccgcggcaagcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggaaatatgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgttt

SEQ ID NO: 34321 - DNA, 550 bp, Homo sapiens
ggcagtgcttcagaattacacatcacatggggagcagcatgctcccactgtgccccagaagagtttcccggacagtgtccagagaatctgttcggaaatatgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctg

SEQ ID NO: 34322 - DNA, 3020 bp, Homo sapiens
agttcctctcccgccgcgccgggccgcgctgccgctcgctccccggccgtggcgcctccgggccagacgcgctgcagcctccagcccgcggcaagcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggaaatatgggatgtataaaatcaaaagggaaagacagcttgagtgacgatggagtagatttgaagactcaaccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgtttaaaaaaaaaaaaaaactaatccaacctgttagattttgcaggtgaagtcagcagcttaaaaatgtctttcccagatttcaatgatttttttccccctacctcccaaaatctgagactgttaaaacatttttcttctatgaacactgctcagacctgctagacatgccataggagtggcgtgcacatctctctctcttccagcaggaggagcccgtgagcacgcacagctgccctgtctgctcacccgaaggcaccgggctcacctggacctcccaggaaagggagaagagcctcagaaactgctctgtgtttagaaggaatatttttaagagtccagctttttcatttccacaatttcctatatccagatttgttttgacaatgtagtttggaagaactaagattctaatctctgaagaaccttatagggccttctaaaacataagagtttcctttgttgcttcaaatatttgaacattatgttaaagatcaagtattaattttagttgtactctagaaagctaaagtgccacattcggggctatttttatgattcagcaatcttttctaaattgtgtagcatgtgtatgagactatttatacccaaggatatgaaggaacataagtgactacaaggctctaataagccacggtggcaggaggttcaagcggttctgttcactaaatttttctcctgtaagctttgaatggaaacttctgtatcacatgatgtgtttcacttatgctgttgtgtatatacctaatatttctatttttgattttattttaatacacctcgtccaataac

SEQ ID NO: 34323 - DNA, 1534 bp, Homo sapiens
gacaggccactcccggccacgtctccaagcaagccggtgccccctcctcctgctgccaccgcccactgagctgcctgggctgcagacgccctggttggagcgtctggggccagatgttatagggcaagctaaaaataaccgggcaggccagccaccatcgaggaaggggcatgtgctggacgcggacacatgatccgagggaccctgctgggtggaactaagaaagtccagcagactgtgcacgctcctgtccccactcacaggcccacgcagcgaggggggcccctcttctgtgtgcgtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgccgaggaggcgggcgcgcccggcggcccccggcagccccgagcagaccgctgcccgccgcctccgcggacgctgccccccggcgcctgccaggccgcgcgctgtcaggcggactccgagtgcccgcggcaccggcgctgctgctacaacggatgcgcctacgcctgcctagaagctgtgccgcccccgccagtcttagactggctggtgcagccgaaacctcgatggcttggtggcaatggctggctcctggatggccctgaggaggtgttacaagcagaggcgtgcagcaccacggaggatggggccgaacccctgctctgtccctcgggctatgagtgccacatcctgagcccaggtgacgtggccgaaggtatccccaaccgtgggcagtgcgtcaagcagcgccggcaagcagatgggcgaatcctacgacacaaactttacaaagaatatccagaaggtgactcaaagaatgtggcagaacctggaaggggacaacagaagcactttcagtaaagcaacggcaagcagctaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccacccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaataagatgccgag

SEQ ID NO: 34324 - DNA, 775 bp, Homo sapiens
aagcacctgcctggcaacatggggtccagcagcttcttggtcctcatggtgtctctcgttcttgtgaccctggtggctgtggaaggagttaaagagggtatagagaaagcaggggtttgcccagctgacaacgtacgctgcttcaagtccgatcctccccagtgtcacacagaccaggactgtctgggggaaaggaagtgttgttacctgcactgtggcttcaagtgtgtgattcctgtgaaggaactggaagaaggaggaaacaaggatgaagatgtgtcaaggccataccctgagccaggatgggaggccaagtgtccaggctcctcctctaccaggtgtcctcagaaatgatgctgggtcctttctacctctgggggtcactctcacttggcacctgcccctgagggtcctgagacttggaatatggaagaagcaatacccaaccccaccaaagaaaacctgagcttgaagtccttttccccaaaaagagggaagagtcacaaaaagtccagaccccagggacggtactttccctctctacctggtgctcctccctaatgctcatgaatggacccctcatgaatgaaaccagtgcccttataagagaccccaaagagctgccttgcccttctgcaatgtgtgatcacagctagaaggcactgtcagagaagagaaactggtcctcaccagatgctgaatctgctggtgccttgatcttggacttcccagcctctagaactgtaagaaataaatatttgctgtttataatcca

SEQ ID NO: 34325 - DNA, 1034 bp, Homo sapiens
ctgactaagtttctctggcttccctgaggctgcaggtgttaatctggggggccctgggccctgagccggcagcagaaatatgaggacccagagccttctcctcctgggggccctcctggctgtggggagtcagctgcctgctgtctttggcaggaagaagggagagaaatcggggggctgcccgccagatgatgggccctgcctcctatcggtgcctgaccagtgcgtggaagacagccagtgtcccttgaccaggaagtgctgctacagagcttgcttccgccagtgtgtccccagggtctctgtgaagctgggcagctgcccagaggaccaactgcgctgcctcagccccatgaaccacctgtgtcacaaggactcagactgctcgggcaaaaagcgatgctgccacagcgcctgcgggcgggattgccgggatcctgccagaggtacggctcctgggtgcccagggcaggctaattctgatttaggatctgtggctctgcacctaagctggggaccaacggaaagagttcacgatgggaggcctggggccctgcccgctggacagcactatctctaccagcggtggttccagccttctgataatcactggcctgctgacacttccctgcaacccatccacccctggtttctcctcctgggagtcaaagtccatagcctgagctcggaggaaggcctctgtatcaccccagtactctgcaccactgccatacgagcttcccacccttcctaacgctttcacaccaatccgtacatgctgcttcctccaccaaaaatgcccaattcaggcagaccctgacctctccctcaggcagcccaaccatccagaatgaatattcttgcagagttttccaaacatcagtcattcacctctttcatgattttcaccatacctacaaaatagcaccatgataggttgcacgctgcctgtaccaccatttacttaatgttttctttaaatggctcacttttgtatataaataaattcatttcaaaagaaaattgatatcact

SEQ ID NO: 34326 - DNA, 1018 bp, Homo sapiens
ctttcctctcctgactaagtttctctggcttccctgaggctgcaggtgttaatctggggggccctgggccctgagccggcagcagaaatatgaggacccagagccttctcctcctgggggccctcctggctgtggggagtcagctgcctgctgtctttggcaggaagaagggagagaaatcggggggctgcccgccagatgatgggccctgcctcctatcggtgcctgaccagtgcgtggaagacagccagtgtcccttgaccaggaagtgctgctacagagcttgcttccgccagtgtgtccccagggtctctgtgaagctgggcagctgcccagaggaccaactgcgctgcctcagccccatgaaccacctgtgtcacaaggactcagactgctcgggcaaaaagcgatgctgccacagcgcctgcgggcgggattgccgggatcctgccagaggctaattctgatttaggatctgtggctctgcacctaagctggggaccaacggaaagagttcacgatgggaggcctggggccctgcccgctggacagcactatctctaccagcggtggttccagccttctgataatcactggcctgctgacacttccctgcaacccatccacccctggtttctcctcctgggagtcaaagtccatagcctgagctcggaggaaggcctctgtatcaccccagtactctgcaccactgccatacgagcttcccacccttcctaacgctttcacaccaatccgtacatgctgcttcctccaccaaaaatgcccaattcaggcagaccctgacctctccctcaggcagcccaaccatccagaatgaatattcttgcagagttttccaaacatcagtcattcacctctttcatgattttcaccatacctacaaaatagcaccatgataggttgcacgctgcctgtaccaccatttacttaatgttttctttaaatggctcacttttgtatataaataaattcatttcaaaagaaaattgatatcact

SEQ ID NO: 34327 - DNA, 2028 bp, Homo sapiens
cctcctcccctctgccctgtgctgaccagggcctgggagcccccgcacggttcagacagaggggccaggctgaagctggagaggaaccagcgtcacacagacggcctctgagaacttggagaccccgttacccacccagcaggggtgtcaggacaagcatctgctgcaggcttcagcctcaggggcaaaagggagccccggggtcctggtgggggcaccgaccacaggcccggagggtggatgcctgcaggaagctgggctctgtggagcccgaggaggggctggtggccacaccccccggccccctggctcggcggccctcatgcccgccctacgtccactcctgccgctcctgctcctcctccggctgacctcgggggctggcttgctgccagggctggggagccacccgggcgtgtgccccaaccagctcagccccaacctgtgggtggacgcccagagcacctgtgagcgcgagtgtagcagggaccaggactgtgcggctgctgagaagtgctgcatcaacgtgtgtggactgcacagctgcgtggcagcacgcttccccggcagcccagctgcgccgacgacagcggcctcctgcgagggctttgtgtgcccacagcagggctcggactgcgacatctgggacgggcagcccgtgtgccgctgccgcgaccgctgtgagaaggagcccagcttcacctgcgcctcggacggcctcacctactacaaccgctgctatatggacgccgaggcctgcctgcggggcctgcacctccacatcgtgccctgcaagcacgtgctcagctggccgcccagcagcccggggccgccggagaccactgcccgccccacacctggggccgcgcccgtgcctcctgccctgtacagcagcccctccccacaggcggtgcaggttgggggtacggccagcctccactgcgacgtcagcggccgcccgccgcctgctgtgacctgggagaagcagagtcaccagcgagagaacctgatcatgcgccctgatcagatgtatggcaacgtggtggtcaccagcatcgggcagctggtgctctacaacgcgcggcccgaagacgccggcctgtacacctgcaccgcgcgcaacgctgctgggctgctgcgggctgacttcccactctctgtggtccagcgagagccggccagggacgcagcccccagcatcccagccccggccgagtgcctgccggatgtgcaggcctgcacgggccccacttccccacaccttgtcctctggcactacgacccgcagcggggcggctgcatgaccttcccggcccgtggctgtgatggggcggcccgcggctttgagacctacgaggcatgccagcaggcctgtgcccgcggccccggcgacgcctgcgtgctgcctgccgtgcagggcccctgccggggctgggagccgcgctgggcctacagcccgctgctgcagcagtgccatcccttcgtgtacggtggctgcgagggcaacggcaacaacttccacagccgcgagagctgcgaggatgcctgccccgtgccgcgcacaccgccctgccgcgcctgccgcctccggagcaagctggcgctgagcctgtgccgcagcgacttcgccatcgtggggcggctcacggaggtgctggaggagcccgaggccgccggcggcatcgcccgcgtggcgctcgaggacgtgctcaaggatgacaagatgggcctcaagttcttgggcaccaagtacctggaggtgacgctgagtggcatggactgggcctgcccctgccccaacatgacggcgggcgacgggccgctggtcatcatgggtgaggtgcgcgatggcgtggccgtgctggacgccggcagctacgtccgcgccgccagcgagaagcgcgtcaagaagatcttggagctgctggagaagcaggcctgcgagctgctcaaccgcttccaggactagcccccgcaggggcctgcgccaccccgtcctggtgaataaacgcactccctgtgcctcag

SEQ ID NO: 34328 - DNA, 3588 bp, Homo sapiens
tggagccagctccccgcaaagcacatgccatttctggcccttgaaggggttaaaggcctcctggagtcaaaaacaagcaggtgtcccaccgtgccagatacgctgcctaaactgcttccagcttctttttttttttttccccccttctgcaataagtctgtgatcagccacgggacagaggcgccagcagcctgcctgtgacaggcatcaggttagctggctcccactcgggtggcgcgcccaggatataaatccgggcgcgggcccctgctgtggctcctctccctgcacactcaggagagggagcttccttctaaagacctttcttttatctgaagccgcacagcccggcaggctgtgctgacttggtggaggcagcagcggcagagcagcctgagcagcagcctgagcaggaaacctgctggggtggggagggcaggtgtctgcagcccctgagaagaaggccctggtgggccccagaccctggcatcgtttcaggggaggtctctagccgccccagcctgcaccatgtgggccccaaggtgtcgccggttctggtctcgctgggagcaggtggcagcgctgctgctgctgctgctactgctcggggtgcccccgcgaagcctggcgctgccgcccatccgctattcccacgccggcatctgccccaacgacatgaatcccaacctctgggtggacgcacagagcacctgcaggcgggagtgtgagacggaccaggagtgtgagacctatgagaagtgctgccccaacgtatgtgggaccaagagctgcgtggcggcccgctacatggacgtgaaagggaagaagggcccagtgggcatgcccaaggaggccacatgtgaccacttcatgtgtctgcagcagggctctgagtgtgacatctgggatggccagcccgtgtgtaagtgcaaagaccgctgtgagaaggagcccagctttacctgcgcctcggacggcctcacctactataaccgctgctacatggatgccgaggcctgctccaaaggcatcacactggccgttgtaacctgccgctatcacttcacctggcccaacaccagccccccaccacctgagaccaccatgcaccccaccacagcctccccagagacccctgagctggacatggcggcccctgcgctgctcaacaaccctgtgcaccagtcggtcaccatgggtgagacagtgagcttcctctgtgatgtggtgggccggccccggcctgagatcacctgggagaagcagttggaggatcgggagaatgtggtcatgcggcccaaccatgtgcgtggcaacgtggtggtcaccaacattgcccagctggtcatctataacgcccagctgcaggatgctgggatctacacctgcacggcccggaacgtggctggggtcctgagggctgatttcccgctgtcggtggtcaggggtcatcaggctgcagccacctcagagagcagccccaatggcacggctttcccggcggccgagtgcctgaagcccccagacagtgaggactgtggcgaagagcagacccgctggcacttcgatgcccaggccaacaactgcctgaccttcaccttcggccactgccaccgtaacctcaaccactttgagacctatgaggcctgcatgctggcctgcatgagcgggccgctggccgcgtgcagcctgcccgccctgcaggggccctgcaaagcctacgcgcctcgctgggcttacaacagccagacgggccagtgccagtcctttgtctatggtggctgcgagggcaatggcaacaactttgagagccgtgaggcctgtgaggagtcgtgccccttccccagggggaaccagcgctgtcgggcctgcaagcctcggcagaagctcgttaccagcttctgtcgcagcgactttgtcatcctgggccgagtctctgagctgaccgaggagcctgactcgggccgcgccctggtgactgtggatgaggtcctaaaggatgagaaaatgggcctcaagttcctgggccaggagccattggaggtcactctgcttcacgtggactgggcatgcccctgccccaacgtgaccgtgagcgagatgccgctcatcatcatgggggaggtggacggcggcatggccatgctgcgccccgatagctttgtgggcgcatcgagtgcccgccgggtcaggaagcttcgtgaggtcatgcacaagaagacctgtgacgtcctcaaggagtttcttggcttgcactgaagccccccacccctccctgccccctccctggccttcttccacctatccaccccaatgcctctcagcaaactgggcgaggtcagattagacaggcttgggacagcagggaaacatcaaccgacgtgtcacagaaaaagccacagaaggtctcagatcagcatctattctttgggttcaataaggggttcatatcttttttagctgagggggacaagaggagaagtcagtggacacatggaagttactcgtgaccaccagcttgctcagatattctcctcctcccctcactggccccacacccctggctctcccagtcaccctcccctagccagtctcccagcaagggtttaagagatggccgctgtgtgctggtcacaggaagtgttgaatggattggcttgcaaagggggtaggtggggagagataggagggcccagggactcatgggacacctttcccacagcctcctcgattgctgtgagcagaggccactcggagttaggggcatgggcaatagcaagctggcggcagagtccagcccagcatatgacttgccctgaatggaagctgctgaaacgggtgcctttgggtggtggtcggcttgcctctgaggccaccacggcaccagcagaatacgtatttcttctccttggctgcactggtttgtcgatctagttcagttcaactcagtggatgttctctgaatgcttactgggtgccaggaccacagagagatgttagtcactgcccagttcttagagccccaacacagataccctcatcccagggcccccagacacacccctccgctggactcacaactgtctggagtttctgtctgatggatggtgtgctttcatatgccactggcttccttggacatagatcagacaaaagccccgggatctgtttggtagcaggagaaatgaaggaagatgaaaaagcaggcagggaagggggtagtaaaggactgagagaggagggaggtggctggagaaggaaaaggaacattgctcgatgctcccatctggtggcggcctcaggaacccacgggaacctggaaggaggctctttgtgagacctgggcaaaggatggggcagctcgtcgatgatttttttgtgtttccaggcttcctgtgtgatcctggccctccggccgctagagagaggattgggaaaccccactgtcagctctgcatctgcccccactaccctcctctgccctattctgtccctgcccctccaagctgaagaaggtccttgtggggcgtcctcatttcttcctcaaatataaggaggaagataccaattaaaagctcatagtatcaa

SEQ ID NO: 34329 - DNA, 849 bp, Homo sapiens
atggacgtgaaagggaagaagggcccagtgggcatgcccaaggaggccacatgtgaccacttcatgtgtctgcagcagggctctgagtgtgacatctgggatggccagcccgtgtgtaagtgcaaagaccgctgtgagaaggagcccagctttacctgcgcccaggccaacaactgcctgaccttcaccttcggccactgccaccgtaacctcaaccactttgagacctatgaggcctgcatgctggcctgcatgagcgggccgctggccgcgtgcagcctgcccgccctgcaggggccctgcaaagcctacgcgcctcgctgggcttacaacagccagacgggccagtgccagtcctttgtctatggtggctgcgagggcaatggcaacaactttgagagccgtgaggcctgtgaggagtcgtgccccttccccagggggaaccagcgctgtcgggcctgcaagcctcggcagaagctcgttaccagcttctgtcgcagcgactttgtcatcctgggccgagtctctgagctgaccgaggagcctgactcgggccgcgccctggtgactgtggatgaggtcctaaaggatgagaaaatgggcctcaagttcctgggccaggagccattggaggtcactctgcttcacgtggactgggcatgcccctgccccaacgtgaccgtgagcgagatgccgctcatcatcatgggggaggtggacggcggcatggccatgctgcgccccgatagctttgtgggcgcatcgagtgcccgccgggtcaggaagcttcgtgaggtcatgcacaagaagacctgtgacgtcctcaaggagtttcttggcttgcactga

SEQ ID NO: 34330 - DNA, 4790 bp, Homo sapiens
gcggccgcggcgcggcgggaccatggagctcagagcgcagccccggcgccggcggcgggaccgcggaccgttttagttttgattgctgttaactactactgataactgagccaaagtggtgatgctacttgaggggaatttctgcaacccatagtcaacgattacatgattgtgaaccatgcctttagtgaagaggaacattgagccccggcacttgtgccggggagctctgcctgaagggattaccagcgaacttgaatgtgtaaccaatagtactcttgccgctatcatacgccagctgagcagtctgagcaaacatgctgaagacatatttggtgagttgtttaatgaggctaacaacttctacatcagagcaaattctcttcaagacagaattgatcgccttgctgtcaaagtcacccagctggattcaacagtggaagaggtctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacagagatgacaagaaggatgggctgaagttctatactgatccttcctatttctttgacctctggaaagaaaaaatgctacaggacacagaagacaaaaggaaagagaaaaggcgtcaaaaggagcaaaagcgtatagatggcaccacccgtgaggtgaaaaaggttagaaaagccagaaacaggcgccaggagtggaatatgatggcatatgacaaagagcttagacccgacaacaggttgtctcagagtgtgtaccatggagcgtcttccgagggatccctgtccccagatactaggtcacatgcatcggacgttacggattactcttacccggctactcccaaccattctctgcacccccagcctgtgaccccttcctatgcagctggtgacgtgccaccacacgggcctgcaagccaggctgcggagcatgagtaccggcccccatctgcctcggcgaggcacatggccctcaacagacctcagcagccgccccccccgcctccccctcaggccccagaggggtcccaggcctctgcaccgatggctccagcagactacgggatgctcccagcgcagataattgagtattacaacccatccggaccacctcctccgccacctcctcctgtgattccctcagcacaaactgccttcgtcagccctctccagatgcccatgcagcccccgttccctgcatcagccagctccacgcacgcagctcctcctcacccaccctccaccgggctcctggtcacagccccgccacccccgggcccaccacctcccccgccaggccctcctggtcccgggtcttctctttcgtcctccccaatgcatggccccccagtagctgaggcgaagcggcaagagcctgcacagccaccaatcagtgatgctcgaagcgacctcctcgctgctattcgaatgggaattcaactgaaaaaggtgcaggagcagcgggagcaggaggccaagcgggagccagtggggaatgacgtggccacgatcctgtcccggcgcattgccgtggagtacagcgactctgacgacgactcagagttcgacgagaacgactggtccgactgagcaaaggccggcggagaggccgcgtgtgggagcgtgttgaagattttaagtggtctctacacccaaatagtggtattctaatcccgtagcatagcaccttttgtataaacaatgtgatattgcttctgcacatccaaaaattctgggtcttttcagtatttactgtgtaatacttaagtgccactaaacatagcaaattgtgctgcacatgaggaaataggctgtcactatcacattgtcctgaaaacagcatctgctttcctcttggccatgagagtatttagtgcagtttgggtttactcttactgatcaatataactctgcagacttgctgtgtgtttgtgaagctgcctggtgttaggtctctgcaagactaatgactatgtcagagtgatgtcttccaaccagtaagtgatattgtttcaccgctttggtttttccttttgtttttttaaaggatgtgtttctgaataagttggttttagagggaaaggttcaacaaacagggagaatccagtgtttctgctttcagtttcttggcttggtagcctctgagtgaatctgatgctctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctcttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaacatcaaaatgttttctgagctccaagtggctaggttgtaaaagttttataataatttgcaattaaaatacatgatacatattaatccattaaagactagtgggaatgtatcagccagagtagcaagtaatttttgttttataaatcatagtatctgtcatcttgcagtattaccaatgctgttgtaaattgaatttaaagtggtattaaaaaaaactgttaaacaatttttatctgtttgtatatcttactatagattatgtacaagtaacatctaaataaaattacacttttaaccctaagaggttttgcttattaataa

SEQ ID NO: 34331 - DNA, 4805 bp, Homo sapiens
gtcgctcgcgccgctgcgtgcggtgtggtgcgaggcgggtgcgccgggcggccgcggcgcggcgggaccatggagctcagagcgcagccccggcgccggcggcgggaccgcggaccgttttagttttgattgctgttaactactactgataactgagccaaagtggtgatgctacttgaggggaatttctgcaacccatagtcaacgattacatgattgtgaaccatgcctttagtgaagaggaacattgagccccggcacttgtgccggggagctctgcctgaagggattaccagcgaacttgaatgtgtaaccaatagtactcttgccgctatcatacgccagctgagcagtctgagcaaacatgctgaagacatatttggtgagttgtttaatgaggctaacaacttctacatcagagcaaattctcttcaagacagaattgatcgccttgctgtcaaagtcacccagctggattcaacagtggaagaggtctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacagagatgacaagaaggatgggctgaagttctatactgatccttcctatttctttgacctctggaaagaaaaaatgctacaggacacagaagacaaaaggaaagagaaaaggcgtcaaaagagagagaaacacaagctgaaccctaacagaaaccagcaagtaaatgtgagaaaagtcagaacaagaaaagaagagtgggagagaaggaaaatgggcattgagtttatgagtgacgcaaagaaactggagcaggcagggagcgccaaagaggacagagtgcccagcgggtcacatgcatcggacgttacggattactcttacccggctactcccaaccattctctgcacccccagcctgtgaccccttcctatgcagctggtgacgtgccaccacacgggcctgcaagccaggctgcggagcatgagtaccggcccccatctgcctcggcgaggcacatggccctcaacagacctcagcagccgccccccccgcctccccctcaggccccagaggggtcccaggcctctgcaccgatggctccagcagactacgggatgctcccagcgcagataattgagtattacaacccatccggaccacctcctccgccacctcctcctgtgattccctcagcacaaactgccttcgtcagccctctccagatgcccatgcagcccccgttccctgcatcagccagctccacgcacgcagctcctcctcacccaccctccaccgggctcctggtcacagccccgccacccccgggcccaccacctcccccgccaggccctcctggtcccgggtcttctctttcgtcctccccaatgcatggccccccagtagctgaggcgaagcggcaagagcctgcacagccaccaatcagtgatgctcgaagcgacctcctcgctgctattcgaatgggaattcaactgaaaaaggtgcaggagcagcgggagcaggaggccaagcgggagccagtggggaatgacgtggccacgatcctgtcccggcgcattgccgtggagtacagcgactctgacgacgactcagagttcgacgagaacgactggtccgactgagcaaaggccggcggagaggccgcgtgtgggagcgtgttgaagattttaagtggtctctacacccaaatagtggtattctaatcccgtagcatagcaccttttgtataaacaatgtgatattgcttctgcacatccaaaaattctgggtcttttcagtatttactgtgtaatacttaagtgccactaaacatagcaaattgtgctgcacatgaggaaataggctgtcactatcacattgtcctgaaaacagcatctgctttcctcttggccatgagagtatttagtgcagtttgggtttactcttactgatcaatataactctgcagacttgctgtgtgtttgtgaagctgcctggtgttaggtctctgcaagactaatgactatgtcagagtgatgtcttccaaccagtaagtgatattgtttcaccgctttggtttttccttttgtttttttaaaggatgtgtttctgaataagttggttttagagggaaaggttcaacaaacagggagaatccagtgtttctgctttcagtttcttggcttggtagcctctgagtgaatctgatgctctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctcttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaacatcaaaatgttttctgagctccaagtggctaggttgtaaaagttttataataatttgcaattaaaatacatgatacatattaatccattaaagactagtgggaatgtatcagccagagtagcaagtaatttttgttttataaatcatagtatctgtcatcttgcagtattaccaatgctgttgtaaattgaatttaaagtggtattaaaaaaaactgttaaacaatttttatctgtttgtatatcttactatagattatgtacaagtaacatctaaataaaattacacttttaaccc

SEQ ID NO: 34332 - DNA, 2858 bp, Homo sapiens
tatttcatctccccaacgcatttgtgacattcttaagggcgtgaaccatgtactcaatagggccctgatgatagaaaagaaaatcagcttggtccctgttctcaagttcatagtttagtgtgggagactaatacaataactcgccgattcaacagatatttttccaacgtccgtatgtattgggtggaaaaggtgaggcaagagttgtatttcccagactcctgaacaggttgcgagatgattgactcctgagggagaccttctcaccttttcattggttgtcgctggccctctcgtctatcacccaaccaaccccgaatgcctcttgtaagccccacctccggcagccagccaatcagaagtgccgggggccagggtgctgctggggcactgacgcggtttcgattctagcgaaaaatgatttggctcggactgtcccgtgacaggcggtgcgaggaggccaggcccgcgcccgccgagccctagggccgctgctgccgacagccatggaggacgagcagcctgacagcctggagggctgggtgccggtccgggagggcctcttcgccgagcccgagaggcaccggctgcgcttcctggtggcctggaacggcgcggagggcaagttcgctgtgacttgtcacgaccgtaccgcgcagcagcggcggctgcgcgagggggcccggttggggcccgagcccgagcccaagcctgaggccgccgtctccccgtccagctgggccggcctgctctcggccgcggggctccgcggcgcgcaccggcagttggcggcgctgtggccgcctctggagcgctgcttcccgcggctgccgccggagctggacgtgggcggcggcggggcctggggtctggggctcgggctgtgggcgctgctgtggccgacgcgcgcgggtcccggcgaggcggcgctgcaggagctgtgcgggcagctggaacgctatctgggcgcggcggccgacggctgcggcggcgccacagtgcgcgacgcactcttcccggctgagggcggcgcggccgactgcgaaagcccgcgcgagttccgggagcgggccttgcgcgcgcggtgggtcgaggcggacgcgcggctgcgccaggttattcaaggacacggaaaagccaacaccatggtagcattaatgaacgtttaccaagaggaagatgaagcataccaggaattggttaccgtggcaaccatgttcttccagtacttattgcagccatttagggctatgcgagaagttgcaactttatgtaagcttgatattttgaagtctttggatgaggatgacctaggtcctagaagggtagttgccctggagaaagaagctgaagaatggaccagacgggctgaagaagctgtcgtctctattcaggatatcacagtgaattattttaaggagacagtaaaagcattagcaggaatgcagaaagaaatggaacaggatgcgaagagatttggtcaggctgcctgggccacagcaattcccaggttggaaaaacttcagctaatgctagctcgagagactctgcaactcatgagagcgaaagagttgtgtttaaatcacaaaagagctgaaattcagggaaagatggaagatcttccagaacaagaaaaaaatacaaatgttgtagatgaattagaaatacaattttatgaaattcaattagaactatatgaagttaaatttgagatattaaaaaacgaagaaatactgcttactacacagttggactctcttaaaagacttataaaagaaaaacaagatgaagttgtctattacgatccatgtgaaaatccagaggaacttaaagtcattgactgtgtggtggggctgcaggatgataagaatttggaagtgaaagaactcagaaggcagtgccagcagctggagtctaaacggggcaggatctgtgccaaaagagcctctctccggagtagaaaggatcagtgcaaagaaaatcatcggttcagattgcaacaggctgaagaaagcataagatactctcgtcagcatcacagtattcagatgaaaagagacaagataaaagaagaggagcaaaagaaaaaagaatggatcaaccaagaacgtcaaaaaacactccaacgattgagatcatttaaagataaacgcctagctcaatctgtccgaaacacctctggctcagaacctgtggctccaaacctgccaagtgatctttcccagcagatgtgcttgccagcttcccacgcggtgtcagtaattcacccgtcctctaggaaaactagaggtgttcccctatcggaagctggtaatgtgaaaagccccaagtgtcaaaactgtcatggaaatatccctgtccaggtttttgttccagttggtgatcaaacacattccaaatccagtgaggaattgtcactgccaccacctcctcctcctccaccaccaccaccgccgccaccgccgcccccaccccctcctctccgtgctctgtcctcatcctctcaagctgcaactcatcagaacttaggcttccgggctccagtgaaagatgaccagccacgtcctctagtgtgcgaatcacctgctgagcgaccacgtgactccttggaaagtttttcatgtccaggatctatggatgaagtgttggcctccttaaggcatggcagagcgcaaggggtcaaactgaagaaagttcaccctgatcttggcccaaaccccagcagcaaaccaaccagcaacagacgcaccagtgaccttgagaggagcatcaaggctgcgctccagagaatcaagagggtgtctgctgactctgaggaggacagtgatgagcaggaccctggccagtgggatggttag

SEQ ID NO: 34333 - DNA, 3852 bp, Homo sapiens
ctagcgaaaaatgatttggctcggactgtcccgtgacaggcggtgcgaggaggccaggcccgcgcccgccgagccctagggccgctgctgccgacagccatggaggacgagcagcctgacagcctggagggctgggtgccggtccgggagggcctcttcgccgagcccgagaggcaccggctgcgcttcctggtggcctggaacggcgcggagggcaagttcgctgtgacttgtcacgaccgtaccgcgcagcagcggcggctgcgcgagggggcccggttggggcccgagcccgagcccaagcctgaggccgccgtctccccgtccagctgggccggcctgctctcggccgcggggctccgcggcgcgcaccggcagttggcggcgctgtggccgcctctggagcgctgcttcccgcggctgccgccggagctggacgtgggcggcggcggggcctggggtctggggctcgggctgtgggcgctgctgtggccgacgcgcgcgggtcccggcgaggcggcgctgcaggagctgtgcgggcagctggaacgctatctgggcgcggcggccgacggctgcggcggcgccacagtgcgcgacgcactcttcccggctgagggcggcgcggccgactgcgaaagcccgcgcgagttccgggagcgggccttgcgcgcgcggtgggtcgaggcggacgcgcggctgcgccaggttattcaaggacacggaaaagccaacaccatggtagcattaatgaacgtttaccaagaggaagatgaagcataccaggaattggttaccgtggcaaccatgttcttccagtacttattgcagccatttagggctatgcgagaagttgcaactttatgtaagcttgatattttgaagtctttggatgaggatgacctaggtcctagaagggtagttgccctggagaaagaagctgaagaatggaccagacgggctgaagaagctgtcgtctctattcaggatatcacagtgaattattttaaggagacagtaaaagcattagcaggaatgcagaaagaaatggaacaggatgcgaagagatttggtcaggctgcctgggccacagcaattcccaggttggaaaaacttcagctaatgctagctcgagagactctgcaactcatgagagcgaaagagttgtgtttaaatcacaaaagagctgaaattcagggaaagatggaagatcttccagaacaagaaaaaaatacaaatgttgtagatgaattagaaatacaattttatgaaattcaattagaactatatgaagttaaatttgagatattaaaaaacgaagaaatactgcttactacacagttggactctcttaaaagacttataaaagaaaaacaagatgaagttgtctattacgatccatgtgaaaatccagaggaacttaaagtcattgactgtgtggtggggctgcaggatgataagaatttggaagtgaaagaactcagaaggcagtgccagcagctggagtctaaacggggcaggatctgtgccaaaagagcctctctccggagtagaaaggatcagtgcaaagaaaatcatcggttcagattgcaacaggctgaagaaagcataagatactctcgtcagcatcacagtattcagatgaaaagagacaagataaaagaagaggagcaaaagaaaaaagaatggatcaaccaagaacgtcaaaaaacactccaacgattgagatcatttaaagataaacgcctagctcaatctgtccgaaacacctctggctcagaacctgtggctccaaacctgccaagtgatctttcccagcagatgtgcttgccagcttcccacgcggtgtcagtaattcacccgtcctctaggaaaactagaggtgttcccctatcggaagctggtaatgtgaaaagccccaagtgtcaaaactgtcatggaaatatccctgtccaggtttttgttccagttggtgatcaaacacattccaaatccagtgaggaattgtcactgccaccacctcctcctcctccaccaccaccaccgccgccaccgccgcccccaccccctcctctccgtgctctgtcctcatcctctcaagctgcaactcatcagaacttaggcttccgggctccagtgaaagatgaccagccacgtcctctagtgtgcgaatcacctgctgagcgaccacgtgactccttggaaagtttttcatgtccaggatctatggatgaagtgttggcctccttaaggcatggcagagctcctctccggaaggtggaagtgccggcggtgcgccctccccacgcctcaatcaatgagcacattctggctgccataaggcaaggggtcaaactgaagaaagttcaccctgatcttggcccaaaccccagcagcaaaccaaccagcaacagacgcaccagtgaccttgagaggagcatcaaggctgcgctccagagaatcaagagggtgtctgctgactctgaggaggacagtgatgagcaggaccctggccagtgggatggttaggctcaagtttgacaaaggcacctgccacagtaggcttgaataaagtgggtgagtcttagacctatcgaaaagcatactaacagggtgctgatagatgggccacataacaccccggaagatcagcagggccttgtgtaggctgctgcagcattttttttttttttcttttttgagatggagtctcactctgtcgcccaggctggggtgcagtggcgccatctcggctcaccgcaagctccgcttcccaggctggggtgcagtggtgcgatcttggctcactgcaagctccgcctcctgggttcacgccattctcctgcctcagcctcccgagtagctgggactacaggcgccaccaccttgcccaactaattttttgtattttttagtagagacgaggtttcaccgtgttagccaggatggtctcgatcttctgacctcgtgatccgcctgcctcagactcccaaagtgctgggattacaggtgtgagccaccacgcccagccttttttttttctttcttttgagacagaatctctctgtcatccaggctagagtgcagtggcacgatcttggcttactgcaacctccacctcccaggttcaagcaattctctgtctcagcctcccgagtagctgggattacaggcatgcaccaccacgcctggctaatttttgtatatttaagtagagacaaggtttcgctatgttggccaggctggtcttgaactcctgacctcgtgatccacctgccttggccacccaaagtgttgggattataggcatgagccaccgtgcctggctgatgctggagcttttatgtgacatggtgactcttaaaactggggagggacgtagagatgagagtttcacacaccagcccataggtgggatgtcaagacccatcggaagtgtcgctggcctaagagaagagcacttatttctcaccatggctgatctagaattgttccctgattctgaaagaagtttacactacactggtaagcagtactattagactactgactgtggccttctgtgcatatggaataatgatttctcagatttgtaggcttgaatgtgaatgttattttatcagtaatcagaataaattgcttatattcaggagttattttaaatatttaaatgaaatttattttaggcaccaagcactacataaactcataataactatttgcaatgcattagcatcactcacggggtaatgaaaacataccttagctgctgtaaaagcaaagtcttccgtgtccgggtgggctgaaagtttttaataaaattttagctaaacatttgtttaagtgaatact

SEQ ID NO: 34334 - DNA, 4002 bp, Homo sapiens
atgccagtgccaccgccacccccacctcctctgcctccacctcccccgcctctgggggctcctccccctcccccaccatcagcacccccggtaagcacagacacctccagcttgcgaagggcagatccgaaaggccggagtgcgctgttggctgatatccagcaaggaactcgcctgcgcaaagtcacgcagatcaacgaccgcagtgccccgcagatcgagagttctaaaggaaccaacaaagaaggaggaggttctgcaaacacacgaggcgcgagcacacctcccaccctgggagatctgtttgctggtggctttcctgtattgcgaccagcaggccagcgggatgtagcaggtggcaagacagggcagggccctggctcccgcgcgccctctcccaggcttcccaacaaaaccatcagcggcccgcttatcccgcctgcctctcccaggctaggcaatacctccgaggcgcatggcgctgccaggacagccccgcctcgccccaacgtgcctgccccgccccctcccaccccaccccctccgcctccacccttacccccgccccttccctcttcctcccccatcaaaactccgcttgtgtccccacccggcccactgaccaaagggaacctcccggtggttgcaccccccgtcccctgtgcgccaccacctccacctccgccacctcccccaacgccacccccgctgcccccggcctcggttcttagtgacaaggcagtgaagcctcagctggctcccttgcacctcccgcccatcccgcccccgctccctctgctcccaccttgtgggtatccggggctcaaagcggagcccgccagccctgcgcaagatgcgcaggagcctcccgccccgccgcccccgctccccccttatgcttcttgctccccgagggcttctttgcccgcgccccctttgccaggagttaatagcagcagtgaaactccacccccgctaccccctaaatcccccagcttccaggccccaccgcagaaggccggtgcgcaggccttgcccgccccgcctgcccctccgggctcccagccgttcctgcagaagaagaggcatggccgaccaggggccggtgggggaaagctaaatccacctccagcaccccctgcgagatcacctaccacagagctttcaagcaagagccagcaggccacagcctggaccccgacgcagcagcctggaggtcaactgcgaaatggaagcctgcacatcattgatgacttcgagtctaaattcacgttccattctgtggaagactttccccctccggatgaatataaaccatgccagaagatttaccccagcaagatccccagaagccgtacacctggtccctggctccaagcggaagcagtcgggcagagctctgatgacatcaaaggcagaaattctcagttatctctaaagactcttcggtgagaagacagatgaagcgaaggtcctggggttccaggttgcagaacaacatgtcagaccccacccaccccatgctcaagctgtaattcagttggcatacaggcttggaattgagaatttatttattgtaaatatgtgatttgcacgggctttaaagcagtattttaattgacttttatttcggtaatattttttaaaacacccctcatttttccattttttgcattgcatcttggcatttgtcagcacagatagagccctgtccctccacctagtgcccactccatgactgtgaatctgcttgcaggctggcccttcctagattctgaaccgtttgtagagagtccttagtttgcaggtagccccaaagttataaatatccacaacggcttcttattggcataatttcatattctcatcacactaactgcaaaatcaaaccaaataatgccttatcaatgatgcagctcagaggaagtagcgtgtcccccacacccagacagtgccgcgcagcctccagggaacgaggtgccatgtctcgcttccattttgcagtacagggaatttttttttttttttttttttttttttttgctgcctaatgtaatacatcacaaagtaaaggcaagagtgggcttggccctccgatgccaaccacagggccccttttgtaactgaataatcctccaagtagccagtgctcctactgtttacagtgtccctcgtgcccaagtctctgtcactttcatcctgttccctccaagttcccagtcccatcccagtagccagctttatgagattttggtatttcttccctacagattaaaaacatacacaactcatcattatgctaaactaccagttgtatctcagaggtctccccttctgcccttgcttcgagtgtggacttccatggaaaatatgacatgaaaaagtgtagaacgaaacatcgtgtgaaatacctgccacaaatacctagtgcctcactgcccccatcttaggatccttggagccacccgtcaggcaaaacctagctcccttctgagctaaaggagaaccttgcctgacaactccacattcattcccttgtggtgggcacctgtctgtggggagatgtgtgcaagctcagccactctgaatatggaaaaggtcaggccgggctggtcctgctcttcactccctcttcttgatcctgtagggagtggaaatgtgtttttgcttgctgcctgacccctgatgttccccatctttggtcggggaagactgtgacagaggaaggagaaaaaatagaaggaaacagactgatccctgggctgtgctcaaaatagctgccctttaaaggaaatcaggcagggaggggagggaaaccagcgaaaaagaaatttgctttgcaacaacccacgcacacattcacccctgaagtatatcatgaacagaccaagccatccagaaaggcagccggtcaggagggtgtgggcaaacatgactgcatctgcctcactgttgtctggagtaacgactcaggtggtgtcctgcagcagtgctgtgctttctcattccagatggaagcaagtgagccagggtcaaattcccttctccaggggaatgaatcaagcccaaactgtaacagctaaataagtagaagtttttgcaggtcatcagctctgggcataactaatttgttttattggttctggaagatttccaaaaagccagaatttattattataacagtgtccactccactgccctcacagttgtgtaaaataattatagaagttttaatgatcctgattaagaagaccctagacaaaggcaattccaccttcagagtagactgcctgccctaatgaggtgtttagacattcgtgtctcctatggctgggatggaaattaaaataacactatttaaggacagagcgggccaggagcagtggctcatgcaggtaatcccagcatgggaggctgaggtgggtggattacttgaggttaggagttcaagaccagcctggccaacatggtgaaaccctgtctactcaaatacaaaaaattagccaggcatggtggctcacacctgtaatcccagcaacttgggaggttcaggcacaagaattgcttgaaccctggaggtggaggttgcagtgagctgagatggcaccactgcactctagcctgggcaacagagcgagaccctaactcaaaaaaaaaaaaggacagaggggaggaaggagcagaaaccaaaaatggcaattagggagaaatctcaggaatgtggcatcccatctccccttgagacctatcactgaattcacaacccttcgagctcatgctggtgcactgagtcccttgggcgctgtaaaggtttaaccccttgactgtaaactcagacttagagacatctgagtcacacagtccccgccattgtcacatattctcactgacactgcagtctgtgactcctccaatgtttcacgtgtattttatatttattgatgtctccttccgcagattcatttctttgtacttaataaactttagtaagtggaaatgctt

SEQ ID NO: 34335 - DNA, 3241 bp, Homo sapiens
atgccagtgccaccgccacccccacctcctctgcctccacctcccccgcctctgggggctcctccccctcccccaccatcagcacccccggtaagcacagacacctccagcttgcgaagggcagatccgaaaggccggagtgcgctgttggctgatatccagcaaggaactcgcctgcgcaaagtcacgcagatcaacgaccgcagtgccccgcagatcgagagttctaaaggaaccaacaaagaaggaggaggttctgcaaacacacgaggcgcgagcacacctcccaccctgggagatctgtttgctggtggctttcctgtattgcgaccagcaggccagcgggatgtagcaggtggcaagacagggcagggccctggctcccgcgcgccctctcccaggcttcccaacaaaaccatcagcggcccgcttatcccgcctgcctctcccaggctaggcaatacctccgaggcgcatggcgctgccaggacagccccgcctcgccccaacgtgcctgccccgccccctcccaccccaccccctccgcctccacccttacccccgccccttccctcttcctcccccatcaaaactccgcttgtgtccccacccggcccactgaccaaagggaacctcccggtggttgcaccccccgtcccctgtgcgccaccacctccacctccgccacctcccccaacgccacccccgctgcccccggcctcggttcttagtgacaaggcagtgaagcctcagctggctcccttgcacctcccgcccatcccgcccccgctccctctgctcccaccttgtgggtatccggggctcaaagcggagcccgccagccctgcgcaagatgcgcaggagcctcccgccccgccgcccccgctccccccttatgcttcttgctccccgagggcttctttgcccgcgccccctttgccaggagttaatagcagcagtgaaactccacccccgctaccccctaaatcccccagcttccaggccccaccgcagaaggccggtgcgcaggccttgcccgccccgcctgcccctccgggctcccagccgttcctgcagaagaagaggcatggccgaccaggggccggtgggggaaagctaaatccacctccagcaccccctgcgagatcacctaccacagagctttcaagcaagagccagcaggccacagcctggaccccgacgcagcagcctggaggtcaactgcgaaatggaagcctgcacatcattgatgacttcgagtctaaattcacgttccattctgtggaagactttccccctccggatgaatataaaccatgccagaagatttaccccagcaagatccccagaagccgtacacctggtccctggctccaagcggaagcagtcgggcagagctctgatgacatcaaaggcagaaattctcaggtaacacaagcctcatgtctctgaatgtaaaaccaggaattctcctcaggaggcacagaaatggtaagggtatgctttctcctaaacagctttatatttttcctcacactccttttcctcagggaaagccatttggtggaccttttttcaagccagaatgaaacactcaccatttcaaaatctgaagtgtgacaaaagggggcttccctggaatcaccactacatatagaagcaagtttagcaactctgacattctgcaacaatcatgccaatcacttcccattcttccttggttatgatggcctgtgagaaaaactgaataacatgtataaaacataattcagtattctctctcatctgtagaatacatggtttcttttagcacacttggagtttttttttcccccaccaatgttataattgattttggccaaatttagtcacaattcaagtactagtacccacaagaaatgaacagaactagaaggcaagccagacagctgcttttgtgataagacagtccttgaagaaacacctttaatctcacccagggcatcttgaaccgaattatttcctaacctggacacatttccctgcacatgacagggtctcatctttaaaagccctttgtttctttgaaaacatgtattcagtcgaacaataatctccccatttctgaatactatgtgacagactacagagtcacttgcagttaaaccaggcaattctgcaactgtgtggaacatcaaggaaagtgacctgagaaggaagaggctaggttcctggaagctaggatgagttcctcagaggaaaaagtacatcctctagcagataagtatcccccttttctaaccacagctgatgcaagaattgcagtaacgattcttagacgatcacaggttcaaaactgtgtgtatgattgtagttaaggaagaagtatatatacacaggaaaaaagacaggaagaatatacacaatattgttaacaggtagagagaattctgagaagatggcagaggagaaagcaccaggaatctgtggacaacaattgcattggcagaatctgtctgatgtaatttgtctcatgtattttggaactctgggattcattaaaggcttgaaacttccatgggaaagcttggacagtaaattgtgctcttagtacaatagtaactactcatcctccaccccccaccccatggcaggcaactgggcacgtgttcctggagcagcttgcatacagcttgcaggagccaaggtgggcacaaaaaaaaaaccctgtcctccagatactggggaatctgttctctgattggttattgctgcttctgatcacagaggtacaaataaagagatgggcagccattgttgcacctcctcttattgttgtaaatccctttccctctggctgaagtggcctcctggggatttcaagggctggtggccattttgttcctcctgtccttgctctttttttttccccatttgggagccaaacattaaagatgaacattcaaaggctactacatatatgatgaaaattagaaagtgaccacatatgcccagggaaaggcacaggctcagaaaagaccaagaagaccttaagattacacctcagactgattcttagcacagagacagcctacaacaatcaaaaaaataaaatgaacaaaaacaataagaaaaaccagcaaaccctgggggacagagagaattgatatctagagttaccacattattagattaaaatgtagagttttcaacaacaacaaaaatcacatcatacaaagaaacaggagagtatggcccattc

SEQ ID NO: 34336 - DNA, 3491 bp, Homo sapiens
cccgcctccgcgtcccggcagcaccagagccggtggccggggagcgagccgggcgcaccgagcgcagctcggcggtagcggcgccgcttggagcacgggcgctgcgggacggagcccggagccggaggcggcggcggcggagacgtcggccggagctcgagtccagtccagcccccggctccgccacctgcagagcagaagccactctcttgggaccattcataagcaggagacatcaacaccgtgacacatgccagtgccaccgccacccccacctcctctgcctccacctcccccgcctctgggggctcctccccctcccccaccatcagcacccccggtaagcacagacacctccagcttgcgaagggcagatccgaaaggccggagtgcgctgttggctgatatccagcaaggaactcgcctgcgcaaagtcacgcagatcaacgaccgcagtgccccgcagatcgagagttctaaaggaaccaacaaagaaggaggaggttctgcaaacacacgaggcgcgagcacacctcccaccctgggagatctgtttgctggtggctttcctgtattgcgaccagcaggccagcgggatgtagcaggtggcaagacagggcagggccctggctcccgcgcgccctctcccaggcttcccaacaaaaccatcagcggcccgcttatcccgcctgcctctcccaggctaggcaatacctccgaggcgcatggcgctgccaggacagccccgcctcgccccaacgtgcctgccccgccccctcccaccccaccccctccgcctccacccttacccccgccccttccctcttcctcccccatcaaaactccgcttgtgtccccacccggcccactgaccaaagggaacctcccggtggttgcaccccccgtcccctgtgcgccaccacctccacctccgccacctcccccaacgccacccccgctgcccccggcctcggttcttagtgacaaggcagtgaagcctcagctggctcccttgcacctcccgcccatcccgcccccgctccctctgctcccaccttgtgggtatccggggctcaaagcggagcccgccagccctgcgcaagatgcgcaggagcctcccgccccgccgcccccgctccccccttatgcttcttgctccccgagggcttctttgcccgcgccccctttgccaggagttaatagcagcagtgaaactccacccccgctaccccctaaatcccccagcttccaggccccaccgcagaaggccggtgcgcaggccttgcccgccccgcctgcccctccgggctcccagccgttcctgcagaagaagaggcatggccgaccaggggccggtgggggaaagctaaatccacctccagcaccccctgcgagatcacctaccacagagctttcaagcaagagccagcaggccacagcctggaccccgacgcagcagcctggaggtcaactgcgaaatggaagcctgcacatcattgatgacttcgagtctaaattcacgttccattctgtggaagactttccccctccggatgaatataaaccatgccagaagatttaccccagcaagatccccagaagccgtacacctggtccctggctccaagcggaagcagtcgggcagagctctgatgacatcaaaggcagaaattctcaggtaacacaagcctcatgtctctgaatgtaaaaccaggaattctcctcaggaggcacagaaatggtaagggtatgctttctcctaaacagctttatatttttcctcacactccttttcctcagggaaagccatttggtggaccttttttcaagccagaatgaaacactcaccatttcaaaatctgaagtgtgacaaaagggggcttccctggaatcaccactacatatagaagcaagtttagcaactctgacattctgcaacaatcatgccaatcacttcccattcttccttggttatgatggcctgtgagaaaaactgaataacatgtataaaacataattcagtattctctctcatctgtagaatacatggtttcttttagcacacttggagtttttttttcccccaccaatgttataattgattttggccaaatttagtcacaattcaagtactagtacccacaagaaatgaacagaactagaaggcaagccagacagctgcttttgtgataagacagtccttgaagaaacacctttaatctcacccagggcatcttgaaccgaattatttcctaacctggacacatttccctgcacatgacagggtctcatctttaaaagccctttgtttctttgaaaacatgtattcagtcgaacaataatctccccatttctgaatactatgtgacagactacagagtcacttgcagttaaaccaggcaattctgcaactgtgtggaacatcaaggaaagtgacctgagaaggaagaggctaggttcctggaagctaggatgagttcctcagaggaaaaagtacatcctctagcagataagtatcccccttttctaaccacagctgatgcaagaattgcagtaacgattcttagacgatcacaggttcaaaactgtgtgtatgattgtagttaaggaagaagtatatatacacaggaaaaaagacaggaagaatatacacaatattgttaacaggtagagagaattctgagaagatggcagaggagaaagcaccaggaatctgtggacaacaattgcattggcagaatctgtctgatgtaatttgtctcatgtattttggaactctgggattcattaaaggcttgaaacttccatgggaaagcttggacagtaaattgtgctcttagtacaatagtaactactcatcctccaccccccaccccatggcaggcaactgggcacgtgttcctggagcagcttgcatacagcttgcaggagccaaggtgggcacaaaaaaaaaaccctgtcctccagatactggggaatctgttctctgattggttattgctgcttctgatcacagaggtacaaataaagagatgggcagccattgttgcacctcctcttattgttgtaaatccctttccctctggctgaagtggcctcctggggatttcaagggctggtggccattttgttcctcctgtccttgctctttttttttccccatttgggagccaaacattaaagatgaacattcaaaggctactacatatatgatgaaaattagaaagtgaccacatatgcccagggaaaggcacaggctcagaaaagaccaagaagaccttaagattacacctcagactgattcttagcacagagacagcctacaacaatcaaaaaaataaaatgaacaaaaacaataagaaaaaccagcaaaccctgggggacagagagaattgatatctagagttaccacattattagattaaaatgtagagttttcaacaacaacaaaaatcacatcatacaaagaaacaggagagtatggcccattc

SEQ ID NO: 34337 - DNA, 2255 bp, Homo sapiens
atctacggggcggcaggaggcccgaagcaagatggcggtgaatcagagccacaccgagaaccgccgcggagccctcatccctaacggtgaaagtctcttgaagcggtctccgaatgtggagctctccttcccacagcgatcagaaggctcaaatgtctttagtggtagaaagacaggaacattgtttctcacttcataccgggtgattttcataacttcatgctccatcagtgatcccatgttgtcttttatgatgccatttgatctgatgacgaacctcactgttgaacaaccagtatttgctgcaaacttcattaagggaactattcaggcagctccatatggtggctgggaaggacaagctacttttaaattagtcttcagaaatggagatgccattgaatttgcccagttgatggtgaaagctgcctctgctgctgcccgaggatttccacttagaaccttaaatgactggttcagctctatgggaatttatgtaattactggggaagggaatatgtgcactccacagatgccttgttcagttattgtctatggagccccacctgcaggatatggagccccacctcccggatacggagccccacctgcaggatatggagcccaacccgtaggaaatgaaggcccgcctgtgggatacagagcctcacctgtgcgatatggagccccacctcttggatacggagccccacctgcaggatatggagccccacctctaggatatggagccccacctcttggatatggaaccccacctctcggatatggagccccacctctcggatatggagccccacctgcaggaaatgaaggcccgcctgcgggatacagagcctcacctgctggatcaggagccaggcctcaggaatctacagcagcccaggctcctgaaaacgaggcttctcttccctctgcctcctcttctcaggtccattcttaaccttctaagatgtaaaccttgaagactcaccaagcaaagaggtaccctaaaattgaagtcaggataaggaggacgactcaggtatgtgatcacaggcttctcgcaggtagttgttccaccctttggaagggcaatcttatgggggaaggtgaaactttacttctgtgcctagattttagaagcagaatcaactcttaaatagctggctaaaggaagaataccattgtggggctaattccccagtaatttggttgacattgggttgcatttttaaacataactttttccacactcgcattcaaggttcctgtcttcccatcctcattcaagaaacatttattatgctccgtttgctaggcactaagatgcgtgctaaaaacgtcatgttgaacacttagttgtttgagaaagctaaattttcaatagtaagagtgttataaattacggtggatccacaaaatggagtattatacacctgttgaaaactatgtctagaggtagagaaagccttctttgaggagaccaaaaccaacaaataaaagcatgataaattgactatatcaaaatttaaaacttctctatgacagaagttaaaagataggcaacagaataggaaaaagtgattttcaacatatatattaatttatagtcagaatacgtgaataactacaaatcaattctccccaaaatgacagaaatatgaattgccgaataaccaaggcaatagcatggccagaaaacgtttgaaaagatgttcagcttgactagtgttagggaaatgcaacctgagatgagaaaacatttttatctccaaagatttacaaatattaaaactcttgatatggcactttcacattttaaaatatgcctgcgagaaaacttgcatgtgtgcacaaagatgcatgtgggaagatttcattatattcattgtttctaacagcacaaaattagaaataacctatatgtccattaataggaaatatatgaataggctatggtatgcccatactacgtatgcagaaatttctaagacttgttgataaggagaaaagcaagttgtagggagcatatactatagtgattttcagcctcatcagactgaatgccccattttataacaaatatttatattttataacaaacgtttatatttgtatatttataacaaatattttgtaatgtctccttcacttcaatgaagtttgtagataattgcatatgattccacaccatttcaaccaaaattaataggccataaatgtgatagaggaaataaaaggagtttgtagtaaaa

SEQ ID NO: 34338 - DNA, 3403 bp, Homo sapiens
ataatctccgccctccccttcagaaccgcgccccacagctcggcgcaggtcccgcccctttccatctacggggcggcaggaggcccgaagcaagatggcggtgaatcagagccacaccgagaaccgccgcggagccctcatccctaacggtgaaagtctcttgaagcggtctccgaatgtggagctctccttcccacagcgatcagaaggctcaaatgtctttagtggtagaaagacaggaacattgtttctcacttcataccgggtgattttcataacttcatgctccatcagtgatcccatgttgtcttttatgatgccatttgatctgatgacgaacctcactgttgaacaaccagtatttgctgcaaacttcattaagggaactattcaggcagctccatatggtggctgggaaggacaagctacttttaaattagtcttcagaaatggagatgccattgaatttgcccagttgatggtgaaagctgcctctgctgctgcccgaggatttccacttagaaccttaaatgactggttcagctctatgggaatttatgtaattactggggaagggaatatgtgcactccacagatgccttgttcagttattgtctatggagccccacctgcaggatatggagccccacctcccggatacggagccccacctgcaggatatggagcccaacccgtaggaaatgaaggcccgcctgtgggatacagagcctcacctgtgcgatatggagccccacctcttggatacggagccccacctgcaggatatggagccccacctctaggatatggagccccacctcttggatatggaaccccacctctcggatatggagccccacctctcggatatggagccccacctgcaggaaatgaaggcccgcctgcgggatacagagcctcacctgctggatcaggagccaggcctcaggaatctacagcagcccaggctcctgaaaacgaggcttctcttccctctgcctcctcttctcaggtccattcttaaccttctaagatgtaaaccttgaagactcaccaagcaaagaggtaccctaaaattgaagtcaggataaggaggacgactcagcttagagtcattgattgatctgcattgtgaaaattaggaaaccagatgctcccatgttctcaaggacagcctttcttaaggaagtcagtacgtgggcaacagtgatgagaggaagagaggagagactcaaccaactagagcagggataaggtttcccttgttcagcttttcagtgtctgctggaatgtgatggtaagttgagaacagggtgaatgggtgaggccttttttatatcagaaagttttccgagtaactgatctctggcaaatatttggggattagaattctaaaagaatacaaactagacttctcttctgctcttcatgttagttatacttgtaccaggtagatttgaggtggggtccagttacctgaaaagcgtagcaggttcgagtttcttaaaggtggaattccaccatgttctcctgtgcaaagggtacctgtttacctggtccaccaaactgccccagtacaaccaaaggctgtgactgtgtaaggatagaaccaagtggagccacagtttggacccacgtggtgctgcgtggcacacctactgttagttagctcccactgtctggtacagttgtttcccccaaaggctcagtccaatttgttctataagaagagctttgtgtcctgtatattcaaaggaccctggtttttgctttgctgaggacaaatccagtcagaattcagctgagccttctgcatgctgagagcactcatgtgctgagttcctcagctcctcactgacgttttgagtactttctttctgactcactcactgtgctggtggattccgctcttcctgtctcttccccagctgcaatacagaaactatactctgttgtctactctttcatttcctattagaaatataaagggatagaaataagaagaccttttagtcctggactatctggtattggcccctaaaatgagcctccaaatactccttttcatgggtaagtggatgctccccagcctgctggagcagaaccttcctggctcagctaccctgagatatcaggacaaaaacatatagttggtgtgattttcctctttttgtttttttttttttcaagatagaatctggctctgtcccccaggctggagtgcagtggcgcgatctcggctcactgcaacctttgccccacaggtttaagcgattctcctgcttcagcctcctgaatagcttggatgacaggtgcctgccaccatgctcggctaatttttgtgtttttagtggagacagggtttcaccatgttggccaggctggtttcgaactcctgacctcaagtgatccacccgcctcggcctcccaaagtgctgggattacaggcatcggcctgtgcctggccgatttttcaatccatagattaatatgttcaagaaatattgcatgtctttgttttctgtaaatttatttctgttaccaagatccccaccaccatctgctttgttggtgggcttctcacaaatcctaagattatgcaaaggtatccagattttatttggcaccaagatgctgagaagtttcttctggtcatcagactgcttctgaaacagccactatccagtcctggcagtcccgtcaagtctaaaagcttgttgccttgggaccccagaatcttaggtagggcttagaaccagggtgtcagagatccaactctgtgtaccatattgctccttagaactggggagtaggaccccaaaggcctccttatccttgagagtctgacaattccttaaacttccagattctgccctctcagctgtgctgttggtctgcatcacctctatctcttaagcatctatcctaatccaaatctcaggatttgggtttacccaaaaggtaatagaaagcctttgccttcatgttgacttggctttccttgcctagcacttggttgcttgcttgaaaatcatgtatgtatatatataaaatgtagaagcccaattcaaattaataatgtaaaaatttattctgttacacagattacctcattgtcaggtaggaagtgaaacgtatgatattcttcctggcctttgccttgagagtcttctggagcctgaagagggtggggcagacaaccatggactgctagagaataaactttctttgaagcttcctaaatggattagaaagaaggggttctgtcaaagggaaagggtctatacagatgtgaccagcagtttgattagtttagatgtatgatttagtagccaatataagaaacttgtaatttttagtaattagaatttattataaataataaaacagggtattaattatt

SEQ ID NO: 34339 - DNA, 1417 bp, Homo sapiens
ggtcccgcccctttccatctacggggcggcaggaggcccgaagcaagatggcggtgaatcagagccacaccgagaaccgccgcggagccctcatccctaacggtgaaagtctcttgaagcggtctccgaatgtggagctctccttcccacagcgatcagaaggctcaaatgtctttagtggtagaaagacaggaacattgtttctcacttcataccgggtgattttcataacttcatgctccatcagtgatcccatgttgtcttttatgatgccatttgatctgatgacgaacctcactgttgaacaaccagtatttgctgcaaacttcattaagggaactattcaggcagctccatatggtggctgggaaggacaagctacttttaaattagtcttcagaaatggagatgccattgaatttgcccagttgatggtgaaagctgcctctgctgctgcccgaggatttccacttagaaccttaaatgactggttcagctctatgggaatttatgtaattactggggaagggaatatgtgcactccacagatgccttgttcagttattgtctatggagccccacctgcaggatatggagccccacctcccggatacggagccccacctgcaggatatggagcccaacccgtaggaaatgaaggcccgcctgtgggatacagagcctcacctgtgcgatatggagccccacctcttggatacggagccccacctgcaggatatggagccccacctctaggatatggagccccacctcttggatatggaaccccacctctcggatatggagccccacctctcggatatggagccccacctgcaggaaatgaaggcccgcctgcgggatacagagcctcacctgctggatcaggagccaggcctcaggaatctacagcagcccaggctcctgaaaacgaggcttctcttccctctgcctcctcttctcaggtccattcttaaccttctaagatgtaaaccttgaagactcaccaagcaaagaggtaccctaaaattgaagtcaggataaggaggacgactcagcttagagtcattgattgatctgcattgtgaaaattaggaaaccagatgctcccatgttctcaaggacagcctttcttaaggaagtcagtacgtgggcaacagtgatgagaggaagagaggagagactcaaccaactagagcagggataaggtttcccttgttcagcttttcagtgtctgctggaatgtgatgatactctagctcacacatcagaagagcatgtgcaggaagagagatgaaataatggtacacgttgatggttactggagctggatgctgggtacatggaggttcactctaccattttatttttgtatttgaaagttttcatgataaaaagtttttaaaaagagaaaggg

SEQ ID NO: 34340 - DNA, 1001 bp, Homo sapiens
atgccatttgatctgatgacgaacctcactgttgaacaaccagtatttgctgcaaacttcattaagggaactattcaggcagctccatatggtggctgggaaggacaagctacttttaaattagtcttcagaaatggagatgccattgaatttgcccagttgatggtgaaagctgcctctgctgctgcccgaggatttccacttagaaccttaaatgactggttcagctctatgggaatttatgtaattactggggaagggaatatgtgcactccacagatgccttgttcagttattgtctatggagccccacctgcaggatatggagccccacctcccggatacggagccccacctgcaggatatggagcccaacccgtaggaaatgaaggcccgcctgtgggatacagagcctcacctgtgcgatatggagccccacctcttggatacggagccccacctgcaggatatggagccccacctctaggatatggagccccacctcttggatatggaaccccacctctcggatatggagccccacctctcggatatggagccccacctgcaggaaatgaaggcccgcctgcgggatacagagcctcacctgctggatcaggagccaggcctcaggaatctacagcagcccaggctcctgaaaacgaggcttctcttccctctgcctcctcttctcaggtccattcttaaccttctaagatgtaaaccttgaagactcaccaagcaaagaggtaccctaaaattgaagtcaggataaggaggacgactcagcttagagtcattgattgatctgcattgtgaaaattaggaaaccagatgctcccatgttctcaaggacagcctttcttaaggaagtcagtacgtgggcaacagtgatgagaggaagagaggagagactcaaccaactagagcagggataaggtttcccttgttcagcttttcagtgtctgctggaatgtgatgattacctcattgtcaggtag

SEQ ID NO: 34341 - DNA, 2722 bp, Homo sapiens
ccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttc

SEQ ID NO: 34342 - DNA, 3142 bp, Homo sapiens
ccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacaattggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttc

SEQ ID NO: 34343 - DNA, 1411 bp, Homo sapiens
gtgtgctggagacaggccagctggggcctgcagcgctctgtcgctctgtgatgttgacatgggtgtggtacttaattatgacctcagtgcttcaagcctcggtttcctcggtggaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatca

SEQ ID NO: 34344 - DNA, 2411 bp, Homo sapiens
ccggccgagaccgagaaggtgttcgccagcctcccgcaggtggagaggggcgtctccaagatcatcggcggcgaccctaagggcaacaattttctgtacaccaatggaaagtgcgtcatcctaaggaacatcgacgaccacagccgctttgtcaactgtgtgcgattctctcctgatgggaacagatttgccacagccagtgctgacggccagtgtctgcctgctcccgtgactgctcagagccgcaggctgcctaatgctagtcctgacatgcagaacttagacatcgccctccccacatctgcagactcgtcgtcagagcccaagccacagtccatggagaaactgcctccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttc

SEQ ID NO: 34345 - DNA, 3054 bp, Homo sapiens
cgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacaattggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 34346 - DNA, 1691 bp, Homo sapiens
cgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaa

SEQ ID NO: 34347 - DNA, 4724 bp, Homo sapiens
cgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgcaactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctgcaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattccatcca

SEQ ID NO: 34348 - DNA, 2124 bp, Homo sapiens
ctttctgatagcaggcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccatggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggg

SEQ ID NO: 34349 - DNA, 1791 bp, Homo sapiens
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccatggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaa

SEQ ID NO: 34350 - DNA, 2150 bp, Homo sapiens
atggaagcagtagtgttaccttggcagatatttggagtacgggagttgcctgtggaaagaggtgtcaccatgaaaggtcccaggctcttcagagcacctggacatgtgcccactggtctcaaatgccatcctgaccaggagcatatgatttatcctcttggttgcacagtcctcattcaggcaataaatactaaagagcagaacttcctacagggtcatggcaacaacgtctcctgcttggccatctccaggtctggagagtacatcgcctccggacaagtcacattcatggggttcaaggcagacatcattttgtgggattataagaacagagagctgcttgctcggctgtcccttcacaaaggcaaaattgaagctctggccttttctccaaatgatttgtacttggtatcactaggaggcccagatgacggaagtgtggtggtgtggagcatagccaagagagatgccatctgtggcagccctgcagccggcctcaatgttggcaatgccaccaatgtgatcttctccaggtgccgggatgagatgtttatgactgctggaaatgggacaattcgagtatgggaattggatcttccaaatagaaaaatctggccaactgagtgccaaacaggacagttgaaaagaatagtcatgagtattggagtggatgatgatgatagctttttctaccttggcaccacgactggagatattctaaaaatgaaccccaggactaaactgctgacagatgttgggcctgcgaaggacaaattcagtttgggagtgtcagctatcaggtgcctgaagatggggggtttgttggtgggctctggagccggactgctggtcttctgtaaaagccctggctacaaacccatcaagaagattcagttacaaggcggcatcacttctatcacacttcgaggagaaggacaccagtttctcgtaggaacagaagaatcgcacatttatcgtgtcagcttcacggatttcaaagagacgctcatagcgacttgtcactttgatgctgtcgaggatattgtctttccatttggcactgctgagctatttgcaacctgtgccaagaaggatatcagggtgtggcacacatcatccaacagggagctgctgcggatcaccgtgcccaacatgacctgccacggcatcgacttcatgagggacggcaaaagcatcatttcagcatggaacgacggtaaaatccgagccttcgccccagagacaggccgactgatgtatgtcattaacaatgctcacaggatcggcgtcaccgccatcgccaccaccagtgactgtaaaagggtcatcagtggcggtggggaaggggaggtgagggtatggcagataggctgtcagacccagaagctggaggaggccctgaaggaacacaagtcatcagtgtcctgcattagggtgaagaggaacaacgaggagtgtgtcaccgccagcaccgatgggacttgtatcatttgggaccttgtgcgtctcaggaggaatcagatgatactagccaacaccttattccagtgtgtgtgctatcaccctgaggagttccagatcatcaccagcggaacagacagaaagattgcttactgggaagtatttgatgggacagtaatcagagaattggaaggttccctgtctgggtcgataaatggcatggatatcacacaggaaggggtgcactttgtcacaggtggaaatgaccatctggtcaaagtttgggattataatgagggtgaagtgactcacgttggggtgggacacagtggcaacatcacacgcatccgcataagtccaggaaatcaatatattgttagtgtaagtgccgatggagccattttgcgatggaagtacccatatacctcctgaagctgatgagatgtctctgagccttggcgttgcacgcagtcctgttgaagactgagtttagataactccaacactagtcttcatttctcacagctctgtttttgttcttgagtcaatttttctctttttctttatagaatgcattttatattcttaaattgcatattaaaattgaagtatgttcaagaataatttgtgcagactctaattagaacttttaacattttgaataaattcttagttgttggttttctgtt

SEQ ID NO: 34351 - DNA, 2193 bp, Homo sapiens
gttaccataacgaccagaagacgctgcagccactagggaggagagcaaagtaatcagaacctcccaaggatggataacaaaatttcgccggaggcccaagtggcggagctggaacttgacgccgtgatcggcttcaatggacatgtgcccactggtctcaaatgccatcctgaccaggagcatatgatttatcctcttggttgcacagtcctcattcaggcaataaatactaaagagcagaacttcctacagggtcatggcaacaacgtctcctgcttggccatctccaggtctggagagtacatcgcctccggacaagtcacattcatggggttcaaggcagacatcattttgtgggattataagaacagagagctgcttgctcggctgtcccttcacaaaggcaaaattgaagctctggccttttctccaaatgatttgtacttggtatcactaggaggcccagatgacggaagtgtggtggtgtggagcatagccaagagagatgccatctgtggcagccctgcagccggcctcaatgttggcaatgccaccaatgtgatcttctccaggtgccgggatgagatgtttatgactgctggaaatgggacaattcgagtatgggaattggatcttccaaatagaaaaatctggccaactgagtgccaaacaggacagttgaaaagaatagtcatgagtattggagtggatgatgatgatagctttttctaccttggcaccacgactggagatattctaaaaatgaaccccaggactaaactgctgacagatgttgggcctgcgaaggacaaattcagtttgggagtgtcagctatcaggtgcctgaagatggggggtttgttggtgggctctggagccggactgctggtcttctgtaaaagccctggctacaaacccatcaagaagattcagttacaaggcggcatcacttctatcacacttcgaggagaaggacaccagtttctcgtaggaacagaagaatcgcacatttatcgtgtcagcttcacggatttcaaagagacgctcatagcgacttgtcactttgatgctgtcgaggatattgtctttccatttggcactgctgagctatttgcaacctgtgccaagaaggatatcagggtgtggcacacatcatccaacagggagctgctgcggatcaccgtgcccaacatgacctgccacggcatcgacttcatgagggacggcaaaagcatcatttcagcatggaacgacggtaaaatccgagccttcgccccagagacaggccgactgatgtatgtcattaacaatgctcacaggatcggcgtcaccgccatcgccaccaccagtgactgtaaaagggtcatcagtggcggtggggaaggggaggtgagggtatggcagataggctgtcagacccagaagctggaggaggccctgaaggaacacaagtcatcagtgtcctgcattagggtgaagaggaacaacgaggagtgtgtcaccgccagcaccgatgggacttgtatcatttgggaccttgtgcgtctcaggaggaatcagatgatactagccaacaccttattccagtgtgtgtgctatcaccctgaggagttccagatcatcaccagcggaacagacagaaagattgcttactgggaagtatttgatgggacagtaatcagagaattggaaggttccctgtctgggtcgataaatggcatggatatcacacaggaaggggtgcactttgtcacaggtggaaatgaccatctggtcaaagtttgggattataatgagggtgaagtgactcacgttggggtgggacacagtggcaacatcacacgcatccgcataagtccaggaaatcaatatattgttagtgtaagtgccgatggagccattttgcgatggaagtacccatatacctcctgaagctgatgagatgtctctgagccttggcgttgcacgcagtcctgttgaagactgagtttagataactccaacactagtcttcatttctcacagctctgtttttgttcttgagtcaatttttctctttttctttatagaatgcattttatattcttaaattgcatattaaaattgaagtatgttcaagaataatttgtgcagactctaattagaacttttaacattttgaataaattcttagttgttggttttctgttataa

SEQ ID NO: 34352 - DNA, 1985 bp, Homo sapiens
gttaccataacgaccagaagacgctgcagccactagggaggagagcaaagtaatcagaacctcccaaggatggataacaaaatttcgccggaggcccaagtggcggagctggaacttgacgccgtgatcggcttcaatgacatcattttgtgggattataagaacagagagctgcttgctcggctgtcccttcacaaaggcaaaattgaagctctggccttttctccaaatgatttgtacttggtatcactaggaggcccagatgacggaagtgtggtggtgtggagcatagccaagagagatgccatctgtggcagccctgcagccggcctcaatgttggcaatgccaccaatgtgatcttctccaggtgccgggatgagatgtttatgactgctggaaatgggacaattcgagtatgggaattggatcttccaaatagaaaaatctggccaactgagtgccaaacaggacagttgaaaagaatagtcatgagtattggagtggatgatgatgatagctttttctaccttggcaccacgactggagatattctaaaaatgaaccccaggactaaactgctgacagatgttgggcctgcgaaggacaaattcagtttgggagtgtcagctatcaggtgcctgaagatggggggtttgttggtgggctctggagccggactgctggtcttctgtaaaagccctggctacaaacccatcaagaagattcagttacaaggcggcatcacttctatcacacttcgaggagaaggacaccagtttctcgtaggaacagaagaatcgcacatttatcgtgtcagcttcacggatttcaaagagacgctcatagcgacttgtcactttgatgctgtcgaggatattgtctttccatttggcactgctgagctatttgcaacctgtgccaagaaggatatcagggtgtggcacacatcatccaacagggagctgctgcggatcaccgtgcccaacatgacctgccacggcatcgacttcatgagggacggcaaaagcatcatttcagcatggaacgacggtaaaatccgagccttcgccccagagacaggccgactgatgtatgtcattaacaatgctcacaggatcggcgtcaccgccatcgccaccaccagtgactgtaaaagggtcatcagtggcggtggggaaggggaggtgagggtatggcagataggctgtcagacccagaagctggaggaggccctgaaggaacacaagtcatcagtgtcctgcattagggtgaagaggaacaacgaggagtgtgtcaccgccagcaccgatgggacttgtatcatttgggaccttgtgcgtctcaggaggaatcagatgatactagccaacaccttattccagtgtgtgtgctatcaccctgaggagttccagatcatcaccagcggaacagacagaaagattgcttactgggaagtatttgatgggacagtaatcagagaattggaaggttccctgtctgggtcgataaatggcatggatatcacacaggaaggggtgcactttgtcacaggtggaaatgaccatctggtcaaagtttgggattataatgagggtgaagtgactcacgttggggtgggacacagtggcaacatcacacgcatccgcataagtccaggaaatcaatatattgttagtgtaagtgccgatggagccattttgcgatggaagtacccatatacctcctgaagctgatgagatgtctctgagccttggcgttgcacgcagtcctgttgaagactgagtttagataactccaacactagtcttcatttctcacagctctgtttttgttcttgagtcaatttttctctttttctttatagaatgcattttatattcttaaattgcatattaaaattgaagtatgttcaagaataatttgtgcagactctaattagaacttttaacattttgaataaattcttagttgttggttttctgtt

SEQ ID NO: 34353 - DNA, 4705 bp, Homo sapiens
gcggggagggtccgcgcgttggtggtgctcgcctcgcagctgcgcccgccggcttcagcaccttccgctgtccgccgctgcagccgcctcctcctccaggtgctgactattctgatgccgagtttccaattgccttgattaaagtagaaacattctatggcttggatgacttacatttcaaattggtttgagcaagatgattggtatgaaggactacaaagagcaaacatgtcccaggtaaggcaagtgggattgctggctgctggatgtcagccatggaacaaggatgtatgtgctgccagtggagacaggtttgcatattgtgcgaccctggctatctatatttatcagttggatcaccgttataatgaattcaaacttcacgcaattatgtctgaacataaaaaaacaatcacagcaatttcttggtgtccacataatcctgatctgtttgcaagtggcagtactgataatttagtgatcatttggaatgttgcagaacaaaaagtcattgctaaactcgacagtacaaaagggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccaggtaataaaaatcagaaacatgttttgagaccagaatctcttgaagggacagatgaagaggatccagttacggccttggaatgggacccactatctactgattatcttctagtggttaatttgcattatggaattcgcctggtagattctgaatcactttcttgcataacaacatttaatcttcccagtgcagcagcttctgtacagtgcttagcctgggttcccagtgctcctgggatgtttataactggagattctcaagtgggtgttttacgcatttggaatgtttcaagaacaacacctattgataatcttaaattaaagaaaacaggatttcactgcttacatgtacttaattctcctccaagaaaaaagttttcagtccaatctccaaccaaaaatcattatacatcctcaacaagcgaagcagttccacccccaactttaacacagaatcaagcattttctcttcctcctggtcatgcagtgtgttgtttcttggatggtggagttggactttatgatatgggagctaagaagtgggattttcttagagacttgggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccaggtggtttaaattgtattgctgggggaacttcccgaaatggtgcttttatttggaatgttcaaaagggcaaaattatacaacgatttaatgagcatggaacaaatggaatattctgcattgcctggagtcataaagattctaaaagaatagcaacctgcagcagtgatggtttctgtattattcgaacaattgatggtaaagtgctacacaaatataaacatccagctgcagtgtttggttgtgattggagccaaaacaataaagacatgatagccactggctgtgaagacacaaatgttcgtgtttattatgtagccaccagctcagatcaaccattgaaagtatttagtgggcatacagcaaaagtgtttcatgttaaatggtctcctctgagagagggaattctttgcagtggttctgatgatggtaccgttcgaatctgggattatactcaggatgcttgcatcaatattcttaatggacacactgcacctgtgagaggattaatgtggaatactgagattccatatctgctcatatctggcagctgggactatactataaaagtatgggacactcgagaaggaacttgtgtggatactgtgtatgatcacggtgcagatgtatatggtttaacctgccatcccagtcgccccttcactatggcctcttgctcccgtgactctacagtgagactctggtcattaacagccttagtcactcctgtacaaataaatattctggcagacagatcttgggaagaaattattgggaacactgattatgctatagaaccaggcactcctcctctactgtgtggtaaagtgtcaagagatattagacaggaaatagaaaaactaactgctaattctcaagtgaaaaaactaagatggttctcagaatgtttatctcctccaggtggcagtgacaatttatggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagaggagagctgaccaattaatccaggaagataaggatgatgtcattccatactgcatagccattggtgatgtgaaaaagctagtccattttttcatgtcaagaggtcagcttaaagaagctctgcttgttgcacaggctgcttgtgaaggaaatatgcagcccttacatgtttccgtgcctaaaggagcttcatattctgatgatatctacaaggaagactttaatgaactcctgcacaaagtcagtaaagaactggcagaatggtattttcaagatggtcgagcagtactagccgcatgttgccatcttgccatagataatattgagcttgctatggcatacctgattcgcggaaatgaactggagttggcagtctgtgtgggcacagtactaggagagtctgcagcaccagcaacccactatgccttagaattactggcgagaaagtgcatgatgatttcagtatgctttccatgtgttggatacagtgtccccttttgttacgttaacaggaatttggcagctgatcttcttctgatgattcctgataatgaactacatttaataaaactctgtgctttctacccaggatgtactgaagagataaatgaccttcatgataagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagagcttgcacacagtccaccaacagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttacgggattaaaaatccagggccctgtgtttttccttgaagacgggaaatctgctatctccttgaatgatgctttgatgtgggcaaaggtgaatccattctcacctttagggactggaatacgactcaatccattctgatagaagatttttgtccatgcttgatttttttttttaaagaaaaactttcatgggttagcattaccttaatctttgttgctcaagtgccagaggttgggagaaggattgcaggttgggagaggtgggaaatagcagtgaattttagtcattaacttcaaaatatatatatatatataatttaaaggaaaaataggtgcctcctttataaacagtaatagctacgtttgggaaggaggaaacatttaaattataaaggactgaataatctaaaaagcatataaaagtttcacacagcataaaagataccaaaatatcatatggttgaaatattgaaacatattaaattgtgcaacacctagaatagtgctagacatacagtaagtacttaatggatatttgaatgattgaatatcttgaaatgttgaaatgtaaggtgtgcacagtgatcttcaacttaacaaacacttacgttctcctttataaaatgcatagtaaaccactaacgttagctgttttaataaaagttttcagttataagtttagtaaatattaataaatggatacacattcaaaatacttt

SEQ ID NO: 34354 - DNA, 1764 bp, Homo sapiens
gtgctcgcctcgcagctgcgcccgccggcttcagcaccttccgctgtccgccgctgcagccgcctcctcctccaggcaaacatgtcccaggtaaggcaagtgggattgctggctgctggatgtcagccatggaacaaggatgtatgtgctgccagtggagacaggtttgcatattgtgcgaccctggctatctatatttatcagttggatcaccgttataatgaattcaaacttcacgcaattatgtctgaacataaaaaaacaatcacagcaatttcttggtgtccacataatcctgatctgtttgcaagtggcagtactgataatttagtgatcatttggaatgttgcagaacaaaaagtcattgctaaactcgacagagcaagaccaccatctccaaaaattatatatataaaaataattaatattatagaagagaatatacacaactcagagatgcaatggataatataaaaagagtacctgagatgtatttttttaaactcttagagatatctgtaactcaaatttttcttaggtgaggaggattattaactggcacatatgtactaaaaacccctcacttaaaaatggcagtctcaatcctactgtcattctttttattttaaaataaataaataagcctatctttttgtgcttacatacttaaaaggatatcattaagtatataaacaatcattacttctgtatttttaatgaatgcaggaaaataatatttttatgtataaaagatgaagaaaaaattttgcaagtctttaagcacataaatacaacagaatagccacccaatttctgtctgaaatctaaattggatggatttgaccatcattctattatctttgatttctacaatgtctatatcttattacctataactattaatttttcatagaattataaatgtcatttgactatgtcaatctgtatatattgtaccttaatatgaaaaacaaattttttaattcataaaagtatttttattagatttcatatgcatgaaacccaagcaaattatatgaatttattttactatttgaaaatgttcatattaccaataatgtggacaaattactttgcaggtttaaatatgcctctgtaaaggaagagtctcattagacaatgatttttaaagcattggaaaaatattttgcctgtaaaagttagtaactaggtggttcacaaaattacaacatcaaaatagttacatcttgtgaaaatatatgatttttatgtcaatcaagacaaatgaaatatatatgtatgtgtatatatatacatgtatgtatgaaatatatatatgtgcgtgtgtgtgtgtatatatatatatatatatatatatttctatgaaattgtccagatgtgttcaggaacatgattgcattagagcaatgactgtattttgttgtccttataacatttatattatttcagttttaagtcaaaaggtattctgaatataataaaagcctcacaaattatttgtaaaatttagtagttcatatttagtatatcagtaatatagaagacatctttatagtcaactcttaattaatgcttattgtaccaaatctttgagatatttgtacataaatgaaatatgtactttcatgctaaaattatatatcatgactgtgctataatttggcatgtcattatctagatttatatgtatgtacgtatttcaggtccttgaaattttaataaatattacagttaaatcctgatatgacatagttaccggct

SEQ ID NO: 34355 - DNA, 7397 bp, Homo sapiens
gcctctggggcagaccctggagatcgggctcgcggcgccttccatcgtggctccgcgctggggcttgcggagcacgcttcccgcccctcggagcccgcgggcccggccgccccgcccccgggcgccctgagcgagcaggcggggagggcggggagggtccgcgcgttggtggtgctcgcctcgcagctgcgcccgccggcttcagcaccttccgctgtccgccgctgcagccgcctcctcctccaggcaaacatgtcccaggtaaggcaagtgggattgctggctgctggatgtcagccatggaacaaggatgtatgtgctgccagtggagacaggtttgcatattgtgcgaccctggctatctatatttatcagttggatcaccgttataatgaattcaaacttcacgcaattatgtctgaacataaaaaaacaatcacagcaatttcttggtgtccacataatcctgatctgtttgcaagtggcagtactgataatttagtgatcatttggaatgttgcagaacaaaaagtcattgctaaactcgacagtacaaaagggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccaggtaataaaaatcagaaacatgttttgagaccagaatctcttgaagggacagatgaagaggatccagttacggccttggaatgggacccactatctactgattatcttctagtggttaatttgcattatggaattcgcctggtagattctgaatcactttcttgcataacaacatttaatcttcccagtgcagcagcttctgtacagtgcttagcctgggttcccagtgctcctgggatgtttataactggagattctcaagtgggtgttttacgcatttggaatgtttcaagaacaacacctattgataatcttaaattaaagaaaacaggatttcactgcttacatgtacttaattctcctccaagaaaaaagttttcagtccaatctccaaccaaaaatcattatacatcctcaacaagcgaagcagttccacccccaactttaacacagaatcaagcattttctcttcctcctggtcatgcagtgtgttgtttcttggatggtggagttggactttatgatatgggagctaagaagtgggattttcttagagacttgggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccaggtggtttaaattgtattgctgggggaacttcccgaaatggtgcttttatttggaatgttcaaaagggcaaaattatacaacgatttaatgagcatggaacaaatggaatattctgcattgcctggagtcataaagattctaaaagaatagcaacctgcagcagtgatggtttctgtattattcgaacaattgatggtaaagtgctacacaaatataaacatccagctgcagtgtttggttgtgattggagccaaaacaataaagacatgatagccactggctgtgaagacacaaatgttcgtgtttattatgtagccaccagctcagatcaaccattgaaagtatttagtgggcatacagcaaaagtgtttcatgttaaatggtctcctctgagagagggaattctttgcagtggttctgatgatggtaccgttcgaatctgggattatactcaggatgcttgcatcaatattcttaatggacacactgcacctgtgagaggattaatgtggaatactgagattccatatctgctcatatctggcagctgggactatactataaaagtatgggacactcgagaaggaacttgtgtggatactgtgtatgatcacggtgcagatgtatatggtttaacctgccatcccagtcgccccttcactatggcctcttgctcccgtgactctacagtgagactctggtcattaacagccttagtcactcctgtacaaataaatattctggcagacagatcttgggaagaaattattgggaacactgattatgctatagaaccaggcactcctcctctactgtgtggtaaagtgtcaagagatattagacaggaaatagaaaaactaactgctaattctcaagtgaaaaaactaagatggttctcagaatgtttatctcctccaggtggcagtgacaatttatggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagaggagagctgaccaattaatccaggaagataaggatgatgtcattccatactgcatagccattggtgatgtgaaaaagctagtccattttttcatgtcaagaggtcagcttaaagaagctctgcttgttgcacaggctgcttgtgaaggaaatatgcagcccttacatgtttccgtgcctaaaggagcttcatattctgatgatatctacaaggaagactttaatgaactcctgcacaaagtcagtaaagaactggcagaatggtattttcaagatggtcgagcagtactagccgcatgttgccatcttgccatagataatattgagcttgctatggcatacctgattcgcggaaatgaactggagttggcagtctgtgtgggcacagtactaggagagtctgcagcaccagcaacccactatgccttagaattactggcgagaaagtgcatgatgatttcagtatgctttccatgtgttggatacagtgtccccttttgttacgttaacaggaatttggcagctgatcttcttctgatgattcctgataatgaactacatttaataaaactctgtgctttctacccaggatgtactgaagagataaatgaccttcatgataagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagagcttgcacacagtccaccaacagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttacgggattaaaaatccagggccctgtgtttttccttgaagacgggaaatctgctatctccttgaatgatgctttgatgtgggcaaaggtgaatccattctcacctttagggactggaatacgactcaatccattctgatagaagatttttgtccatgcttgatttttttttttaaagaaaaactttcatgggttagcattaccttaatctttgttgctcaagtgccagaggttgggagaaggattgcaggttgggagaggtgggaaatagcagtgaattttagtcattaacttcaaaatatatatatatatataatttaaaggaaaaataggtgcctcctttataaacagtaatagctacgtttgggaaggaggaaacatttaaattataaaggactgaataatctaaaaagcatataaaagtttcacacagcataaaagataccaaaatatcatatggttgaaatattgaaacatattaaattgtgcaacacctagaatagtgctagacatacagtaagtacttaatggatatttgaatgattgaatatcttgaaatgttgaaatgtaaggtgtgcacagtgatcttcaacttaacaaacacttacgttctcctttataaaatgcatagtaaaccactaacgttagctgttttaataaaagttttcagttataagtttagtaaatattaataaatggatacacattcaaaatacttttaaaaaaaagaaaatgttaccagtttttttatctgaagtttaactgtcccattgtaaaggtgtaagttatataggcttgaaaaaaattggcgggtaaaaatcacaaaatgcagtcgaatatatatatgaaaacttgcattaggtgataaagtgactattttaagagattcagcatgcatggatattagttttgattaatgtgtacaataatttacacagtatactctagtcaatttatgttaactttatttaaaacacaatttatttggccgggcacggtggctcacacctgtaatctcagcactttggcaggccaaggcaggtggatcacctgaggtcaggagttcatgaccagcctggccagcatggtaaaaccctgtctccactaaaaatacaaaaattagccaggcatggtggcgggcacctgtaatcccagttacttgggaagctgaggcaggagaatcccttgaacctgggaggcagaggttccagtgagccaagatcgcaccactgcactccagcctgggcaacaaagagcgaaactctgtctcaaaaaacaaaccaacaaaaaccacaattgatttgatgaaaattagttttaagtaaatgtttgtaaatagatattggttgaatttttggatatattatgttgatttaacttttaaaatgttgtttaaaagtgtgaagctatgaaaagcctgataatgtgactacagatatttcagttggactagaattctgactttgaaacttattaaattaatgcatactggaagtactttgatactcaagttgtttcacaagatttataatatagatggttttgtttgactaaagaataatctcatataactagaatacttgtggcttttattatctttaaacttgttgcatttaaaatatttttaaaaccttcttaacaaaacttcttaaaactggaaaaaatatatattatgtatctatgtatcatatttatcacatgaccacttttgattccttaaaaagacattacaggcttaaattccattttattaaaaaaaaaaaattgcctgtaatcccagcacttcaggaggccgagatgggcagatcttgaggtcggtagatggagaccatcctggccaacatggtgaaaccctgtctctactaaaaatacaaaaattagctgggtgtggtggtgtgtacctgtagtcccagctacccaggaagctaaggcaggagaatcgcttgaatccaggaggcggaggttgcagtgagctgagatcgcactactgcactccagcctgggcgacagagcaagaccaccatctccaaaaattatatatataaaaataattaatattatagaagagaatatacacaactcagagatgcaatggataatataaaaagagtacctgagatgtatttttttaaactcttagagatatctgtaactcaaatttttcttaggtgaggaggattattaactggcacatatgtactaaaaacccctcacttaaaaatggcagtctcaatcctactgtcattctttttattttaaaataaataaataagcctatctttttgtgcttacatacttaaaaggatatcattaagtatataaacaatcattacttctgtatttttaatgaatgcaggaaaataatatttttatgtataaaagatgaagaaaaaattttgcaagtctttaagcacataaatacaacagaatagccacccaatttctgtctgaaatctaaattggatggatttgaccatcattctattatctttgatttctacaatgtctatatcttattacctataactattaatttttcatagaattataaatgtcatttgactatgtcaatctgtatatattgtaccttaatatgaaaaacaaattttttaattcataaaagtatttttattagatttcatatgcatgaaacccaagcaaattatatgaatttattttactatttgaaaatgttcatattaccaataatgtggacaaattactttgcaggtttaaatatgcctctgtaaaggaagagtctcattagacaatgatttttaaagcattggaaaaatattttgcctgtaaaagttagtaactaggtggttcacaaaattacaacatcaaaatagttacatcttgtgaaaatatatgatttttatgtcaatcaagacaaatgaaatatatatgtatgtgtatatatatacatgtatgtatgaaatatatatatgtgcgtgtgtgtgtgtatatatatatatatatatatatatttctatgaaattgtccagatgtgttcaggaacatgattgcattagagcaatgactgtattttgttgtccttataacatttatattatttcagttttaagtcaaaaggtattctgaatataataaaagcctcacaaattatttgtaaaatttagtagttcatatttagtatatcagtaatatagaagacatctttatagtcaactcttaattaatgcttattgtaccaaatctttgagatatttgtacataaatgaaatatgtactttcatgctaaaattatatatcatgactgtgctataatttggcatgtcattatctagatttatatgtatgtacgtatttcaggtccttgaaattttaataaatattacagttaaatcctgatatgacatagtt

SEQ ID NO: 34356 - DNA, 4294 bp, Homo sapiens
gcctctggggcagaccctggagatcgggctcgcggcgccttccatcgtggctccgcgctggggcttgcggagcacgcttcccgcccctcggagcccgcgggcccggccgccccgcccccgggcgccctgagcgagcaggcggggagggcggggagggtccgcgcgttggtggtgctcgcctcgcagctgcgcccgccggcttcagcaccttccgctgtccgccgctgcagccgcctcctcctccaggcaaacatgtcccaggtaaggcaagtgggattgctggctgctggatgtcagccatggaacaaggatgtatgtgctgccagtggagacaggtttgcatattgtgcgaccctggctatctatatttatcagttggatcaccgttataatgaattcaaacttcacgcaattatgtctgaacataaaaaaacaatcacagcaatttcttggtgtccacataatcctgatctgtttgcaagtggcagtactgataatttagtgatcatttggaatgttgcagaacaaaaagtcattgctaaactcgacagtacaaaagggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccaggtaataaaaatcagaaacatgttttgagaccagaatctcttgaagggacagatgaagaggatccagttacggccttggaatgggacccactatctactgattatcttctagtggttaatttgcattatggaattcgcctggtagattctgaatcactttcttgcataacaacatttaatcttcccagtgcagcagcttctgtacagtgcttagcctgggttcccagtgctcctgggatgtttataactggagattctcaagtgggtgttttacgcatttggaatgtttcaagaacaacacctattgataatcttaaattaaagaaaacaggatttcactgcttacatgtacttaattctcctccaagaaaaaagttttcagtccaatctccaaccaaaaatcattatacatcctcaacaagcgaagcagttccacccccaactttaacacagaatcaagcattttctcttcctcctggtcatgcagtgtgttgtttcttggatggtggagttggactttatgatatgggagctaagaagtgggattttcttagagacttgggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccaggtggtttaaattgtattgctgggggaacttcccgaaatggtgcttttatttggaatgttcaaaagggcaaaattatacaacgatttaatgagcatggaacaaatggaatattctgcattgcctggagtcataaagattctaaaagaatagcaacctgcagcagtgatggtttctgtattattcgaacaattgatggtaaagtgctacacaaatataaacatccagctgcagtgtttggttgtgattggagccaaaacaataaagacatgatagccactggctgtgaagacacaaatgttcgtgtttattatgtagccaccagctcagatcaaccattgaaagtatttagtgggcatacagcaaaagtgtttcatgttaaatggtctcctctgagagagggaattctttgcagtggttctgatgatggtaccgttcgaatctgggattatactcaggatgcttgcatcaatattcttaatggacacactgcacctgtgagaggattaatgtggaatactgagattccatatctgctcatatctggcagctgggactatactataaaagtatgggacactcgagaaggaacttgtgtggatactgtgtatgatcacggtgcagatgtatatggtttaacctgccatcccagtcgccccttcactatggcctcttgctcccgtgactctacagtgagactctggtcattaacagccttagtcactcctgtacaaataaatattctggcagacagatcttgggaagaaattattgggaacactgattatgctatagaaccaggcactcctcctctactgtgtggtaaagtgtcaagagatattagacaggaaatagaaaaactaactgctaattctcaagtgaaaaaactaagatggttctcagaatgtttatctcctccaggtggcagtgacaatttatggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagaggagagctgaccaattaatccaggaagataaggatgatgtcattccatactgcatagccattggtgatgtgaaaaagctagtccattttttcatgtcaagaggtcagcttaaagaagctctgcttgttgcacaggctgcttgtgaaggaaatatgcagcccttacatgtttccgtgcctaaaggagcttcatattctgatgatatctacaaggaagactttaatgaactcctgcacaaagtcagtaaagaactggcagaatggtattttcaagatggtcgagcagtactagccgcatgttgccatcttgccatagataatattgagcttgctatggcatacctgattcgcggaaatgaactggagttggcagtctgtgtgggcacagtactaggagagtctgcagcaccagcaacccactatgccttagaattactggcgagaaagtgcatgatgatttcagtatggaatttggcagctgatcttcttctgatgattcctgataatgaactacatttaataaaactctgtgctttctacccaggatgtactgaagagataaatgaccttcatgataagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagagcttgcacacagtccaccaacagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttacgggattaaaaatccagggccctgtgtttttccttgaagacgggaaatctgctatctccttgaatgatgctttgatgtgggcaaaggtgaatccattctcacctttagggactggaatacgactcaatccattctgatagaagatttttgtccatgcttgatttttttttttaaagaaaaactttcatgggttagcattaccttaatctttgttgctcaagtgccagaggttgggagaaggattgcaggttgggagaggtgggaaatagcagtgaattttagtcattaacttcaaaatatatatatatatataatttaaaggaaaaa

SEQ ID NO: 34357 - DNA, 4249 bp, Homo sapiens
atagttcgcgtagcggctcgagcgtggagatgaagcgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgaggaaaacatactaagagaatcacttgtggatgttggaatgcagaaaatctgcttgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgatagaaagcgaaatcttggatgctcaagaagaacgtgagactcggcttttcccagcagtggatgataagtgccgtatcttatgccatgccttaactagtgatttcctcatctatggtacagatactggtgtcgttcagtatttctacattgaagactggcaattcgttaatgattatcgacatcctgtcagtgtgaaaaagatttttcccgacccaaatgggaccagattagttttcattgatgaaaaaagtgatggatttgtttactgtccagtcaatgacgctacctatgagattccagatttttcaccaaccattaaaggtgttctttgggaaaactggccaatggataaaggtgtatttattgcttatgatgatgataaggtgtacacttatgtctttcacaaggacactatacaaggagccaaggttattttggctggtagcaccaaagttccttttgctcataaacctttgctgctatataatggagagctgacctgccaaacacagagtggaaaagtaaacaacatctaccttagcacccatggctttctcagcaacttaaaagatacggggcctgacgaactgagaccaatgctggcacagaatttaatgctaaagaggttttctgatgcttgggaaatgtgcaggattctgaatgatgaggctgcctggaatgagttggccagagcttgtctacatcacatggaagtggagtttgcaatccgtgtttatcggagaattggaaatgttggcatagtgatgtccttggaacaaataaagggaatagaggactacaatcttttggcaggacaccttgccatgtttaccaacgattataacctggctcaggacttgtaccttgcatccagctgtcctattgctgccctggagatgagaagggatttacagcattgggacagtgctctacaactggcaaagcatttggccccagaccagataccttttatatcaaaagaatatgctattcagcttgaattcgcgggtgattatgtaaatgctttggctcattatgagaaaggaataacaggtgataataaggaacatgatgaagcttgtctggctggagtggcccagatgtccataagaatgggagacatacgtcgaggggttaaccaagccctcaagcatcccagcagggtccttaaaagagactgtggagccatattggagaatatgaagcaattttcagaagcggcccaactgtatgaaaaaggtctctactacgataaagcagcatctgtttacatccgctctaagaattgggcaaaagttggtgatcttctgccccacgtttcttctcctaagatccatttgcagtatgccaaagccaaggaagcagatggaagatacaaagaagctgttgtagcttatgaaaatgcaaaacagtggcaaagtgtaatccgcatctatctggatcacctcaataatcctgaaaaagctgtcaatattgttagagagacccagtctctggatggagccaaaatggtagccaggttttttctacagcttggtgactatgggtctgccatccagtttcttgtcatgtccaaatgcaacaatgaagctttcacactggctcagcaacacaacaaaatggaaatctatgcagatattattggttctgaagacactactaatgaagactatcaaagcattgccttatactttgaaggagaaaagagatatcttcaggctggaaaattcttcttgctgtgtggccaatattcacgagcacttaaacacttcctgaaatgcccaagctcggaagataatgtggcaatagaaatggcaattgaaactgttggtcaggccaaagatgaactgctgaccaatcagctgatagaccatctcctgggggagaacgatggcatgcctaaggatgccaagtacctgttccgcttgtacatggctctgaagcaataccgagaagctgcccagactgccatcatcattgccagagaagagcagtctgcaggcaactaccggaatgcacacgatgttctcttcagtatgtatgcagaactgaaatcccagaagatcaaaattccctccgagatggccaccaacctcatgattctgcacagctatatactagtaaagattcatgttaaaaatggagatcacatgaaaggggctcgcatgctcattcgggtggccaacaacatcagcaaatttccatcacacattgtacccatcctgacgtcaactgtgattgagtgtcacagggcaggcctgaagaactctgctttcagcttcgcagctatgttgatgaggcctgaataccgcagcaaaatagatgccaaatacaaaaagaagatcgagggaatggtcaggagacccgatatatctgagatagaagaggccacgactccatgtccattctgcaaatttcttctcccagagtgtgaactcctctgtcctggatgtaaaaacagtatcccatattgcattgcaacaggtcgacacatgttgaaagatgactggacggtgtgtccacattgtgacttccctgctctatactcagaattgaagatcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacacactctatcctctgcactgttaatagtaacctatgacataattgtaaatattcagctttttgctaacttttgtattttg

SEQ ID NO: 34358 - DNA, 4520 bp, Homo sapiens
ggcccggcccctcgaggcaccgcctttcaattagcactcgctgattggtcgctgctcgcgcggtctcctgggtgacgggaacgcggtagcctgcttggtggagaccgggtgcgcctgcgtacttcatagttcgcgtagcggctcgagcgtggagatgaagcgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagggatcaaatgtctttccttctttggtcaaaagttggaagtttcctggctgttggaactgttaaaggaaatttgcttatttataatcatcagacatctcgaaagattcctgtccttggaaaacatactaagagaatcacttgtggatgttggaatgcagaaaatctgcttgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgatagaaagcgaaatcttggatgctcaagaagaacgtgagactcggcttttcccagcagtggatgataagtgccgtatcttatgccatgccttaactagtgatttcctcatctatggtacagatactggtgtcgttcagtatttctacattgaagactggcaattcgttaatgattatcgacatcctgtcagtgtgaaaaagatttttcccgacccaaatgggaccagattagttttcattgatgaaaaaagtgatggatttgtttactgtccagtcaatgacgctacctatgagattccagatttttcaccaaccattaaaggtgttctttgggaaaactggccaatggataaaggtgtatttattgcttatgatgatgataaggtgtacacttatgtctttcacaaggacactatacaaggagccaaggttattttggctggtagcaccaaagttccttttgctcataaacctttgctgctatataatggagagctgacctgccaaacacagagtggaaaagtaaacaacatctaccttagcacccatggctttctcagcaacttaaaagatacggggcctgacgaactgagaccaatgctggcacagaatttaatgctaaagaggttttctgatgcttgggaaatgtgcaggattctgaatgatgaggctgcctggaatgagttggccagagcttgtctacatcacatggaagtggagtttgcaatccgtgtttatcggagaattggaaatgttggcatagtgatgtccttggaacaaataaagggaatagaggactacaatcttttggcaggacaccttgccatgtttaccaacgattataacctggctcaggacttgtaccttgcatccagctgtcctattgctgccctggagatgagaagggatttacagcattgggacagtgctctacaactggcaaagcatttggccccagaccagataccttttatatcaaaagaatatgctattcagcttgaattcgcgggtgattatgtaaatgctttggctcattatgagaaaggaataacaggtgataataaggaacatgatgaagcttgtctggctggagtggcccagatgtccataagaatgggagacatacgtcgaggggttaaccaagccctcaagcatcccagcagggtccttaaaagagactgtggagccatattggagaatatgaagcaattttcagaagcggcccaactgtatgaaaaaggtctctactacgataaagcagcatctgtttacatccgctctaagaattgggcaaaagttggtgatcttctgccccacgtttcttctcctaagatccatttgcagtatgccaaagccaaggaagcagatggaagatacaaagaagctgttgtagcttatgaaaatgcaaaacagtggcaaagtgtaatccgcatctatctggatcacctcaataatcctgaaaaagctgtcaatattgttagagagacccagtctctggatggagccaaaatggtagccaggttttttctacagcttggtgactatgggtctgccatccagtttcttgtcatgtccaaatgcaacaatgaagctttcacactggctcagcaacacaacaaaatggaaatctatgcagatattattggttctgaagacactactaatgaagactatcaaagcattgccttatactttgaaggagaaaagagatatcttcaggctggaaaattcttcttgctgtgtggccaatattcacgagcacttaaacacttcctgaaatgcccaagctcggaagataatgtggcaatagaaatggcaattgaaactgttggtcaggccaaagatgaactgctgaccaatcagctgatagaccatctcctgggggagaacgatggcatgcctaaggatgccaagtacctgttccgcttgtacatggctctgaagcaataccgagaagctgcccagactgccatcatcattgccagagaagagcagtctgcaggcaactaccggaatgcacacgatgttctcttcagtatgtatgcagaactgaaatcccagaagatcaaaattccctccgagatggccaccaacctcatgattctgcacagctatatactagtaaagattcatgttaaaaatggagatcacatgaaaggggctcgcatgctcattcgggtggccaacaacatcagcaaatttccatcacacattgtacccatcctgacgtcaactgtgattgagtgtcacagggcaggcctgaagaactctgctttcagcttcgcagctatgttgatgaggcctgaataccgcagcaaaatagatgccaaatacaaaaagaagatcgagggaatggtcaggagacccgatatatctgagatagaagaggccacgactccatgtccattctgcaaatttcttctcccagagtgtgaactcctctgtcctggatgtaaaaacagtatcccatattgcattgcaacaggtcgacacatgttgaaagatgactggacggtgtgtccacattgtgacttccctgctctatactcagaattgaagatcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacacactctatcctctgcactgttaatagtaacctatgacataattgtaaatattcagctttttgctaacttttgtattttgaaaaactttaaaataaaattgttgactaga

SEQ ID NO: 34359 - DNA, 1966 bp, Homo sapiens
aaacgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagggatcaaatgtctttccttctttggtcaaaagttggaagtttcctggctgttggaactgttaaaggaaatttgcttatttataatcatcagacatctcgaaagattcctgtccttggaaaacatactaagagaatcacttgtggatgttggaatgcagaaaatctgcttgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgaaagcgaaatcttggatgctcaagaagaacgtgagactcggcttttcccagcagtggatgataagtgccgtatcttatgccatgccttaactagtgatttcctcatctatggtacagatactggtgtcgttcagtatttctacatctctatactcagaattgaagatcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacacactctatcctctgcactgttaatagtaacctatgacataattgtaaatattcagctttttgctaacttttgtattttgaaaaactttaaaataaaattgttgact

SEQ ID NO: 34360 - DNA, 2513 bp, Homo sapiens
gagcgtggagatgaagcgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagggatcaaatgtctttccttctttggtcaaaagttggaagtttcctggctgttggaactgttaaaggaaatttgcttatttataatcatcagacatctcgaaagattcctgtccttggaaaacatactaagagaatcacttgtggatgttggaatgcagaaaatctgcttgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgaaagcgaaatcttggatgctcaagaagaacgtgagactcggcttttcccagcagtggatgataagtgccgtatcttatgccatgccttaactagtgatttcctcatctatggtacagatgtatgtattgccttcttttttagagaacactgggaatttttaatttttattttgtgatctcagtcattctcttttcctaccagtcttttttctatattgaatccaatacaattaatgaagttatctgtgattaattatatacattcatgtgtctctttgcagtggggatacattctgagaaacgtgtcattgggcaatttcatcattgtgtggatgtcatagagtgtgcttacaggaacctagatggtacagcccactgcacacctagcctgtgtggtagagcctattgctcctaggctacaaaccagtacagcatgtgactgtactgaatactataggtaattgtaacacaatgctatctagacatagacaaggtacagtatatgtgtgatataaaatatttaaaatggcatgcctgtatagggcacttaccatgacaggagcttgcaggactggaaatggctctgggtgagtgagtgagtgagtggtgagtgaacgtgaaggcctgcagcattactgtacactaccatagatttttatcaacactgtacacttagggacactaaacttatttaaacattttttcttcaaaaataaattaaccttagctcactgtaactttataagctttatatttaaaaaaactttttgactcttttgtagtaacacttagcttaaaacacaaacacattgtacagttacacaaaatattttcttaaaaaatattttattatatcctattctataagcttttccttgtttttcactttttttaacttttaaactttttataaaaactaagacacaaacacacacattagtgcaggcctgcatagcatcaggatcatcagtatcactgtctcccacctccgcatcttgtcccactgaaaggtcttcagcgggaataacatgcatggagctgtcatctcctgtgataacaatgccttcttctggatacctcctgaaggacctggttgagcctgttttacagttaacttttttttaataaatagaagtgcactccaaaa

SEQ ID NO: 34361 - DNA, 3858 bp, Homo sapiens
ctcgtggaggctgagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggacacagatattattgtatgggatgtgatcaatgaaagtggtctgtaccgtctaaaggggcacaaggatgccatcacacaagcattgtttctacgagaaaagaacctgctagttactagtgggaaagataccatggtgaaatggtgggaccttgatactcagcactgctttaaaacaatggttggccaccggactgaggtatgggggttggttctgttgtcagaagaaaagcgactcatcactggggcctcagacagtgaactgagggtatgggacatagcttatctgcaagagattgaagacccggaagaaccagaccccaagaaaatcaaaggatcttctcctggaatacaagatactcttgaggcagaggatggtgcctttgagacggatgaagcccctgaggatcgaatcctttcatgcagaaaagctggttccataatgcgggaaggaagagacagagttgtaaaccttgcagtcgacaagacaggcaggattcttgcttgccatggaactgactctgtgctagaattgttttgtatcctttccaaaaaggaaattcagaagaaaatggataagaagatgaagaaagctagaaagaaagcaaaattacattctagcaaaggagaggaggaagatcctgaggttaatgttgaaatgagtctgcaagatgaaatccagcgggtgactaatataaaaacttctgccaaaatcaagtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggtctacactgcagtgtattcgcacaatgacctgtgaatatgcactttgctcattctttgtacctggtgatagacaggtagtcataggaacaaagacagggaagctgcagctttatgacttggcttcagggaatctgctggagacaatagatgcacatgatggagctttgtggtccatgtccctctctccagatcagcgtggctttgtgacaggtggtgcagataaatctgtcaaattctgggattttgagttagtgaaagatgaaaatagtacccaaaagagactttctgtgaagcaaacccgaactttgcaactagatgaagatgttctgtgtgtcagttactctcccaatcaaaagctattggctgtgtctttgctggactgtactgtgaaaattttctacgttgatactttaaagttttttctgtcactgtatggacacaaactgcctgttatatgcatggacatctctcatgatggagcactcatagcaactggctccgctgataggaatgtgaaaatctggggtttggactttggggactgccacaagtctctctttgcacatgatgacagtgtgatgtacctacagtttgtacccaagtctcacctcttcttcactgccggaaaagatcataagattaaacagtgggatgcagacaaatttgaacacatacagactctggagggtcatcaccaggaaatatggtgtttggctgtaagccccagtggagactatgttgtatcatcgtcccatgacaaatctctgagactttgggagagaacaagggagcctcttattcttgaggaagaaagggagatggaaagagaagcagaatatgaggagagtgtggccaaagaagaccaaccagcagttccaggagagactcaaggtgacagttactttactggaaagaaaactattgaaacagtgaaagcagctgagaggattatggaggctattgagttgtaccgagaagaaactgcaaaaatgaaggaacacaaagccatttgtaaagctgcagggaaagaggttccacttcccagcaaccccatcctaatggcttatggcagtatctcaccttcagcttatgtattagagatttttaaagggatcaagtcgagtgagctggaagaatctctacttgtgctgcctttctcttatgtcccagacattcttaaactctttaacgaattcattcagctgggctctgatgttgaacttatatgccggtgcctcttcttcctccttaggattcactttggacagatcactagcaatcaaatgcttgtgccagtgatagaaaaattaagggaaacaactatttcaaaagtcagccaagtccgggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaactttttcctttaaaggactcctaaactaagcacagaagagttggcgtcatcttaaaaataccaaataacagaagatcgcattgcagatgatatcaggatgtggtttccagctttgcctgagggaattccaacatgagattatgggctggctccatttcttggacttaaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttctaattaaaaagtagccaagctaagatgcctggctgggcttctgaggaattaatacactcgtgtgtgtgtgtgtgtgtgtgtgtgtgtgtgtgtgtgtatgtgtatgtgtatgtacacatacatatatatagttgacacttgaaaaatgcaggtggtaggggcactgacccacccctacgccccgcacagtcaaaaatctgcatataacttttgattccccaaagtcttaagtactagtagcctgttattgactgggagcctgactgatgtattatatatattgtatactgtattcttaaagtaagctagagaaaagaaaatgttacttagaaaatcataaggaagagaaaatatatttactgtgtttatcaatact

SEQ ID NO: 34362 - DNA, 1035 bp, Homo sapiens
ggacccggaaggggcaggtcttgtgggcgggtccaatcggctgggagcctcgtggaggctgagattgcttcacctgtggtatcagacatcacaacatggggctcaccaagcagtacctacgctatgttgctagtgcggtctttggcgttatcggcagccaaaaaggtctagctagccaagcatcaagttcctttgtgttcttcgccactgaattctgaaaaccacaatgaaataggagcttatttcttagatgtctatttgttggaatatttacagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggacacagatattattgtatgggatgtgatcaatgaaagtggtctgtaccgtctaaaggggcacaaggatgccatcacacaagcattgtttctacgagaaaagaacctgctagttactagtgggaaagataccatggtgaaatggtgggaccttgatactcagcactgctttaaaacaatggttggccaccggactgaggtatgggggttggttctgttgtcagaagaaaagcgactcatcactggggcctcagacagtgaactgagggtatgggacatagcttatctgcaagagattgaagacccggaagaaccagaccccaagaaaatcaaaggatcttctcctggaatacaagatactcttgaggcagaggatggtgcctttgagacggatgaagcccctgaggatcgaatcctttcatgcagaaaagctggttccataatgcgggaaggaagagacagagttgtaaaccttgcagtcgacaagacaggcaggattcttgcttgccatggaactgactctgtgctagaattgttttgtatcctttcc

SEQ ID NO: 34363 - DNA, 1755 bp, Homo sapiens
ggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgctgggagacgaaaagttgccagacggccagcattgccactgccagtgcatccgcccaggccaggaatcatgtggacgcccaggtgcagacggaggcccccgtgcctgtcagcgtgcagcccccgtcccagtatgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcagccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccaccgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctt

SEQ ID NO: 34364 - DNA, 745 bp, Homo sapiens
gctggtgttgcggcgctggcgacagtcggggttgcgagcggcccggggccggggcggccagggccgctgcaggacgagaccctgggtgtggcgtccgtgccctcgcagtggagggccgtccagggcatccgctgggagacgaaaagttgccagacggccagcattgccactgccagtgcatccgcccaggccaggaatcatgtggacgcccaggtgcagacggaggcccccgtgcctgtcagcgtgcagcccccgtcccagtatgacatacccaggctcgcagcctttcttcggagagtggaggccatggtcatccgagagctgaacaagaattggcagagccacgcgtttgatggcttcgaggtgaactggaccgagcagcagcagatggctggaccatggggactggagcacgcttaagtccttcgtgtgtgcctggaacctggaccggcgagacctgcgtccccagcagccgtcggccgtggtggaggtccccagcgctgtcctgtgtctggccttccaccccacgcagccctcccacgtcgcaggtgagctgcctgctgtgtccgcctcctctcctctcaggactcagcttcccgccctgcagagggcacaagggagctttccatgggccctttggcccggagacaggaaggcgggccctgaccctctcagtctggagcccaggtgaaggtctgcagtgagccctgaggggtggaactcgggggaggagtctggaaggggg

SEQ ID NO: 34365 - DNA, 1039 bp, Homo sapiens
ctcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgctgggagacgaaaagttgccagacggccagcattgccactgccagtgcatccgcccaggccaggaatcatgtggacgcccaggtgcagacggaggcccccgtgcctgtcagcgtgcagcccccgtcccagtatgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcagccgtcggccgtggtggaggtccccagcgctgtcctgtgtctggccttccaccccacgcagccctcccacgtcgcaggtgagctgcctgctgtgtccgcctcctctcctctcaggactcagcttcccgccctgcagagggcacaagggagctttccatgggccctttggcccggagacaggaaggcgggccctgaccctctcagtctggagcccaggtgaaggtctgcagtgagccctgaggggtggaactcgggggaggagtctggaagggggccagggtcggggccaggacagggggctgtggagaggccagaagaggcaggtgcccttgggaagccgtcagtggtagggggcaggcaacgctggagggagctgccaggtgcagggcaggggtgtccggcaaagctccctggggtacaacaggggagctgggggctag

SEQ ID NO: 34366 - DNA, 6918 bp, Homo sapiens
agggcgacgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggaacaaggaacaagggttcatagcatgcggtggtgaagatggattactgaaagttttgaaattagagacgcagacagatgatgcaaaattgaggggccttgcagcccccagtaacctttctatgaatcagactcttgaaggtcatagtggttctgttcaagttgtaacatggaatgagcagtatcagaagttgactaccagtgatgaaaacgggcttatcattgtgtggatgttatataaaggctcttggattgaggagatgatcaacaatcgaaataaatcagttgttcgcagtatgagctggaatgctgacggacagaagatctgcattgtatatgaagatggggctgtgatagttggttcagtggatggcaatcgtatttggggaaaagacctgaagggtatacagctatcccatgtaacatggtctgcggacagtaaagtcttactttttggaatggcaaatggggaaatacacatttacgataatcaaggaaattttatgataaaaatgaaactgagttgtttggtgaatgtcactggagctatcagcattgctggaattcattggtaccatggcacagaaggctacgtggagcctgattgcccttgccttgctgtttgctttgataatggaagatgccaaataatgagacatgagaatgaccaaaatcccgttttgattgacactggcatgtacgtagtaggcatccagtggaaccacatgggcagcgtgttagctgtggcaggcttccagaaggcagccatgcaggacaaagatgtgaacattgtgcagttttacactccgtttggtgagcatctgggtactttgaaagttcctggaaaggaaatatctgcactatcttgggaaggaggtggactgaaaattgcactagctgttgattcctttatatattttgcaaacattcgacctaattataagtggggttattgctcaaacactgtagtttatgcatataccagacctgatcgtccagaatattgtgttgtcttctgggatacgaaaaacaatgaaaaatatgttaaatatgtgaagggtctcatttctattactacctgtggagatttctgcattttggctacaaaagctgatgaaaatcatcctcagtttgtactagttctttgtaattctattggtacacccttggatcccaaatacattgatattgtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgaagggttagagaaccttgccatttcacttccagaaaaccacaagttacttccagaaatagcacaaatgtttgtcagagttggaatgtgtgaacaagcagtgactgcatttttgaaatgtagtcaaccaaaggcagcagtagatacctgcgtacatctcaaccaatggaacaaagctgttgaattggctaaaaatcatagtatgaaagaaattggatctctgttagctaggtatgcatctcatttactggaaaagaataaaactcttgatgccatagaactctatcggaaagccaattacttttttgatgcagctaaactgatgtttaagattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagctcttcacctgaaagactatgaagacatcatccctcctgtggagatctactctctgctagcactctgcgcatgcgccagcagagcctttgggacttgttcaaaagctttcattaaacttaaatctttagagaccctcagttcagaacagaaacagcagtatgaagaccttgctttagaaatcttcaccaaacatacttcaaaagataacagaaaacctgaattggacagccttatggaaggtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttctctcaccctctctcttttgtttatcttgtttttggttacatgataccatggaaatattccaaataaatttttttctcacagtgtcaaggtaactgaattcattaaaaaatcttgaagggagtagggagtgggggaagcatgggagtggggcaaagttgaatttagagaatttttataacccatgttacaaggaagttaaacaattgtaataatgaaatgagctttctctatagccatatttaattaaataagtgtcgaatgtcttctttattgtattttcagaagtgaggcgatggcattttaagacattttttacaatctgaattgtttctaatagccctattcttctattttaaaacctgtccttttagtctcatttaagagatggcatttggaatttacactttcatatgattgtgcagaaaacttgcctctatttataatgaagataacttaaacagaaatatccattttgtagttatagcttctgttgaaacattgtcactaagttggaccgtttatttacacaagtattgttgagggagtgattttttcttgatatgcgtctgttttcatttattattaatttgaaagataaacagttgtgatccataatggatcatttcttatgtcttttacatagctaataatgttctctgtttatttctcatgaattcccattttgtggctaaagaccagacctttgcactatttcatcaagattattttattgaggtttggcttacatatagtagaggcaatacatagagatacgcaactttgtttttgcagctacaatacactttctcaatctcatatgtttttgtcttgtagagacagagacaagttcagcatgttgcagattgggaatagtgagctatgagaagagatttagagcctagatgagcttaggatagagagtgggctcattggcctaaataaaaagagaagaccagaagtctttgaggtctctgtctctattcatgcgcctcgtggaaaattaccttggtacaatggtagcctctaaatagactgcctcgcaagctattccagaggtcatggaacagaaagccttataaaccaaataaaaattctcaaaatacattggtttattgaaccaatttgcaatacacagtgaggaacaaggagaaagcaatgatagattaacactgttagtgtaacgtgccagtggagtggaaagaccgcaacacctgaatcctgggttttgtaatgtttttatgtcctgactcacattctgtcacatacgctttcccctaatagtcgggttacaaaaaggaccagagtggccgcttgagccagatgactcaatcagatgaaatgtgcctgaggccaacgatgtacacttgctctatagaagggtgtcaggggcaagtacacttcaccacagcaatagcttgcctattagtctgctgagcagtcatgaattttattgtatttcttgggtaaggacaggccagaatgagtgtcaccagtgggtaattgaatcaacttctcacacatactgaaggctttatatgtctcatgcatacttagtgtatcatgaatatttggtatctttgtggcttttcatatttttagtgcttcatgaatatttggtatctcttgctcctttctatctgtggtcacacatacacgctctattaactttgcctaataagtctcctaggttactaacttacttacctaaatgtaacacaatgaattccagctttctcatttgttctataccagaatgggaaatttccccaaatcagaaaatcacatcctaacaaagaagtctgtctaagacagtacatctcctgttgaacttgcatctttccacaggactttctgtttttagggatgagactattctctgcttcatcaaggaaagagaaatgttcagggttgtagggatggcacacttattagttctgcctgtctgaaaggttcctgcaggacagtttggtcagagctgcaattcttagtccatggtctaatgcttgagtatctcttctttccctttcctgtctcaggaatcagctgagaattcattcgattgtcatgcctctagccccttactgtgatttgttggttgcactttcatttgctttagttctagaatcacctgttgactcctcagacttcacctaactttggaaactctcttttggaggcttctcatttccccctaattctgtgctgcctgagccctagaattttcccaccaacgaattattccaggtagatcctaagttgctggatctagttgatatttaaacaatatctagttgatatttctcattcagttggatccagaaaccagtatctctaaaaacaacctctcataccttgtggacctaattttgtgtgcgtgtgtgtgtgcgcgcatatgtatatagacaggcacatcttttttacttttgtaaaagcttatgcctctttggtatctatatctgtgaaagttttaatgatctgccataatgtcttggggacctttgtcttctgtgtaaatggtactagagaaaacacctatattatgagtcaatctagttggttttattcgacatgaaggaaatttccagataacaacactaacaaactctcccttgactagggggacaaagaaaagcaaaactgaccataaaaaacaattacctggtgagaagttgcataaacagaattaggtagtatattgaagacagcatcattaaacagttatgttgttctccttgcaaaaaacatgtactgacttcccgttgagtaatgccaagttgttttttttattataaaacttgcccttcattacatgtttcaaagtggtgtggtgggccaaaatattgaaatgatggaactgactgataaagctgtacaaataagcagtgtgcctaacaagcaacacagtaatgttgacatgcttaattcacaaatgctaatttcattataaattgttttgctaaaatacactttgaaactatttttctgtattccaagagctgagatcttagattttatgtagtattaagtgaaaaaatacgaaaataataaacattgaagaaaaaaataa

SEQ ID NO: 34367 - DNA, 6960 bp, Homo sapiens
gcggttgccagggcgacgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggaacaaggaacaagggttcatagcatgcggtggtgaagatggattactgaaagttttgaaattagagacgcagacagatgatgcaaaattgaggggccttgcagcccccagtaacctttctatgaatcagactcttgaaggtcatagtggttctgttcaagttgtaacatggaatgagcagtatcagaagttgactaccagtgatgaaaacgggcttatcattgtgtggatgttatataaaggctcttggattgaggagatgatcaacaatcgaaataaatcagttgttcgcagtatgagctggaatgctgacggacagaagatctgcattgtatatgaagatggggctgtgatagttggttcagtggatggcaatcgtatttggggaaaagacctgaagggtatacagctatcccatgtaacatggtctgcggacagtaaagtcttactttttggaatggcaaatggggaaatacacatttacgataatcaaggaaattttatgataaaaatgaaactgagttgtttggtgaatgtcactggagctatcagcattgctggaattcattggtaccatggcacagaaggctacgtggagcctgattgcccttgccttgctgtttgctttgataatggaagatgccaaataatgagacatgagaatgaccaaaatcccgttttgattgacactggcatgtacgtagtaggcatccagtggaaccacatgggcagcgtgttagctgtggcaggcttccagaaggcagccatgcaggacaaagatgtgaacattgtgcagttttacactccgtttggtgagcatctgggtactttgaaagttcctggaaaggaaatatctgcactatcttgggaaggaggtggactgaaaattgcactagctgttgattcctttatatattttgcaaacattcgacctaattataagtggggttattgctcaaacactgtagtttatgcatataccagacctgatcgtccagaatattgtgttgtcttctgggatacgaaaaacaatgaaaaatatgttaaatatgtgaagggtctcatttctattactacctgtggagatttctgcattttggctacaaaagctgatgaaaatcatcctcaggaggagaacgagatggagacatttggtgcaacgtttgtactagttctttgtaattctattggtacacccttggatcccaaatacattgatattgtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgaagggttagagaaccttgccatttcacttccagaaaaccacaagttacttccagaaatagcacaaatgtttgtcagagttggaatgtgtgaacaagcagtgactgcatttttgaaatgtagtcaaccaaaggcagcagtagatacctgcgtacatctcaaccaatggaacaaagctgttgaattggctaaaaatcatagtatgaaagaaattggatctctgttagctaggtatgcatctcatttactggaaaagaataaaactcttgatgccatagaactctatcggaaagccaattacttttttgatgcagctaaactgatgtttaagattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagctcttcacctgaaagactatgaagacatcatccctcctgtggagatctactctctgctagcactctgcgcatgcgccagcagagcctttgggacttgttcaaaagctttcattaaacttaaatctttagagaccctcagttcagaacagaaacagcagtatgaagaccttgctttagaaatcttcaccaaacatacttcaaaagataacagaaaacctgaattggacagccttatggaaggtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttctctcaccctctctcttttgtttatcttgtttttggttacatgataccatggaaatattccaaataaatttttttctcacagtgtcaaggtaactgaattcattaaaaaatcttgaagggagtagggagtgggggaagcatgggagtggggcaaagttgaatttagagaatttttataacccatgttacaaggaagttaaacaattgtaataatgaaatgagctttctctatagccatatttaattaaataagtgtcgaatgtcttctttattgtattttcagaagtgaggcgatggcattttaagacattttttacaatctgaattgtttctaatagccctattcttctattttaaaacctgtccttttagtctcatttaagagatggcatttggaatttacactttcatatgattgtgcagaaaacttgcctctatttataatgaagataacttaaacagaaatatccattttgtagttatagcttctgttgaaacattgtcactaagttggaccgtttatttacacaagtattgttgagggagtgattttttcttgatatgcgtctgttttcatttattattaatttgaaagataaacagttgtgatccataatggatcatttcttatgtcttttacatagctaataatgttctctgtttatttctcatgaattcccattttgtggctaaagaccagacctttgcactatttcatcaagattattttattgaggtttggcttacatatagtagaggcaatacatagagatacgcaactttgtttttgcagctacaatacactttctcaatctcatatgtttttgtcttgtagagacagagacaagttcagcatgttgcagattgggaatagtgagctatgagaagagatttagagcctagatgagcttaggatagagagtgggctcattggcctaaataaaaagagaagaccagaagtctttgaggtctctgtctctattcatgcgcctcgtggaaaattaccttggtacaatggtagcctctaaatagactgcctcgcaagctattccagaggtcatggaacagaaagccttataaaccaaataaaaattctcaaaatacattggtttattgaaccaatttgcaatacacagtgaggaacaaggagaaagcaatgatagattaacactgttagtgtaacgtgccagtggagtggaaagaccgcaacacctgaatcctgggttttgtaatgtttttatgtcctgactcacattctgtcacatacgctttcccctaatagtcgggttacaaaaaggaccagagtggccgcttgagccagatgactcaatcagatgaaatgtgcctgaggccaacgatgtacacttgctctatagaagggtgtcaggggcaagtacacttcaccacagcaatagcttgcctattagtctgctgagcagtcatgaattttattgtatttcttgggtaaggacaggccagaatgagtgtcaccagtgggtaattgaatcaacttctcacacatactgaaggctttatatgtctcatgcatacttagtgtatcatgaatatttggtatctttgtggcttttcatatttttagtgcttcatgaatatttggtatctcttgctcctttctatctgtggtcacacatacacgctctattaactttgcctaataagtctcctaggttactaacttacttacctaaatgtaacacaatgaattccagctttctcatttgttctataccagaatgggaaatttccccaaatcagaaaatcacatcctaacaaagaagtctgtctaagacagtacatctcctgttgaacttgcatctttccacaggactttctgtttttagggatgagactattctctgcttcatcaaggaaagagaaatgttcagggttgtagggatggcacacttattagttctgcctgtctgaaaggttcctgcaggacagtttggtcagagctgcaattcttagtccatggtctaatgcttgagtatctcttctttccctttcctgtctcaggaatcagctgagaattcattcgattgtcatgcctctagccccttactgtgatttgttggttgcactttcatttgctttagttctagaatcacctgttgactcctcagacttcacctaactttggaaactctcttttggaggcttctcatttccccctaattctgtgctgcctgagccctagaattttcccaccaacgaattattccaggtagatcctaagttgctggatctagttgatatttaaacaatatctagttgatatttctcattcagttggatccagaaaccagtatctctaaaaacaacctctcataccttgtggacctaattttgtgtgcgtgtgtgtgtgcgcgcatatgtatatagacaggcacatcttttttacttttgtaaaagcttatgcctctttggtatctatatctgtgaaagttttaatgatctgccataatgtcttggggacctttgtcttctgtgtaaatggtactagagaaaacacctatattatgagtcaatctagttggttttattcgacatgaaggaaatttccagataacaacactaacaaactctcccttgactagggggacaaagaaaagcaaaactgaccataaaaaacaattacctggtgagaagttgcataaacagaattaggtagtatattgaagacagcatcattaaacagttatgttgttctccttgcaaaaaacatgtactgacttcccgttgagtaatgccaagttgttttttttattataaaacttgcccttcattacatgtttcaaagtggtgtggtgggccaaaatattgaaatgatggaactgactgataaagctgtacaaataagcagtgtgcctaacaagcaacacagtaatgttgacatgcttaattcacaaatgctaatttcattataaattgttttgctaaaatacactttgaaactatttttctgtattccaagagctgagatcttagattttatgtagtattaagtgaaaaaatacgaaaataataaacattgaagaaaaaaataa

SEQ ID NO: 34368 - DNA, 2788 bp, Homo sapiens
agggtatacagctatcccatgtaacatggtctgcggacagtaaagtcttactttttggaatggcaaatggggaaatacacatttacgataatcaaggaaattttatgataaaaatgaaactgagttgtttggtgaatgtcactggagctatcagcattgctggaattcattggtaccatggcacagaaggctacgtggagcctgattgcccttgccttgctgtttgctttgataatggaagatgccaaataatgagacatgagaatgaccaaaatcccgttttgattgacactggcatgtacgtagtaggcatccagtggaaccacatgggcagcgtgttagctgtggcaggcttccagaaggcagccatgcaggacaaagatgtgaacattgtgcagttttacactccgtttggtgagcatctgggtactttgaaagttcctggaaaggaaatatctgcactatcttgggaaggaggtggactgaaaattgcactagctgttgattcctttatatattttgcaaacattcgacctaattataagtggggttattgctcaaacactgtagtttatgcatataccagacctgatcgtccagaatattgtgttgtcttctgggatacgaaaaacaatgaaaaatatgttaaatatgtgaagggtctcatttctattactacctgtggagatttctgcattttggctacaaaagctgatgaaaatcatcctcagtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgaagggttagagaaccttgccatttcacttccagaaaaccacaagttacttccaattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttctctcaccctctctcttttgtttatcttgtttttggttacatgataccatggaaatattccaaataaatttttttctcacagtgtc

SEQ ID NO: 34369 - DNA, 7048 bp, Homo sapiens
tcaaggaatactgacttaatccaggaatcccaataacatttaatatttatcttccttttctgggaggaatctacacttatccaagttgcccaagtgagcagttccctccccacaagtaattagttctactccccagagggtctgtgagtgaatccctctgtcagttttgaaatgtcccattatagttttcatctgtaaatatgtcaatatgtatccaaaagatgaggatctttaaaaacgtaatcataatgctactatcatatgtaaaaatgaaacataattccttaatatcatcagatatccagtgtttaaatttttccagtctcatgtttttgtacatttttaaataatcacatgtttaaatcgtttccatctccaaggcgtcgacctcccctccattctcctgggcgtcgcgcttccctctttgtttcccgcccttgcggttctgtcggaacctaacgagcttccttccaccgcaaaagagctggagaacaatgctaggcaacgtgctggagaccttggccctcggaacccaagtcacgcctcccatgtgagctctggagggagaactttatgtgttgcactgagggcagtctccggaaacgcgattcgcagcgggcgccggaagcggtgttgtgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgttcagaaacttagtctggttgcagtaagtaattctgttccacaggatatctgctgtatggcagctgatggcagattagtctttgctgcttatggaaatgttttctctgcatttgcccgtaataaagagatagtacatacctttaagggtcataaggcagaaatccatttcttgcaaccctttggagaccacattatctctgttgatactgatggcattcttattatttggcacatatattcagaagaagaatacctgcagttgacttttgataaatcagtatttaaaatttctgcaattttgcatccaagtacctacttgaataaaatacttctgggcagtgaacaaggaagcctgcagttgtggaatgtaaaatccaataaacttctatatacatttccaggatggaaagttggagtgacagctcttcagcaggcaccagccgtggatgttgttgctattggtcttatgtcaggtcaagttatcattcacaacattaaatttaatgaaacattaatgaagtttcgtcaagactggggacccattacttcaatttcatttcgcacagatggtcatccagtaatggcagctggaagcccatgtggccatattggactctgggatctagaagacaaaaaattaatcaaccaaatgagaaatgcacactctacagcaattgccggactgacatttctccatagagagccacttcttgtcacaaatggcgctgacaatgctcttaggatatggatatttgatggtcctacaggtgaaggccgacttttgagattcagaatgggtcatagtgctcctcttaccaatatcagatattatggacagaatggacagcagattctaagtgcaagtcaagatggaactcttcagtcattttccacggtacatgaaaaattcaataagagcttgggacatggattaataaataaaaagagagttaaacgtaaaggacttcagaataccatgtcagtgagacttccacccatcacaaagtttgcagcagaggaagctcgtgaaagtgactgggatggtatcattgcttgccatcaaggtaagctatcttgctcaacctggaattatcagaaatctacaataggcgcttactttctcaagccaaaagagttgaagaaagatgacataactgcaacagcagtggatataacttcttgtggaaactttgctgtaattggcctctcatcaggaactgtagatgtatataacatgcagtctggcatacatcgaggaagttttggcaaggatcaagctcacaagggatctgttagaggtgtcgcagtggatggattaaaccagttgacagttacaactggtagtgaaggattactcaaattctggaactttaaaaacaaaattttaatccattctgtgagcctcagttcatctccaaatatcatgttgctacatagggacagtggcattctgggactcgccttggatgacttctccattagtgttctggacatagaaactaggaagattgtcagagagttttctggacaccaaggccaaataaatgacatggcttttagtcctgatggtcgttggttaataagtgctgcgatggattgctctattaggacttgggaccttccttctgggtgccttatagactgctttttgttggactcggctcctctcaatgtttctatgtctcctactggagactttctggcaacttcccatgtggaccaccttggaatttatctatggtccaatatttccctgtattcagttgtttcattacggccacttcctgcagattatgtcccttcaatagtcatgcttcctggtacttgtcaaacccaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggttttttttattttgttttgttttgtttttttttttttttttttggctacacttttttgggggggaccttttaatttgggaagaaaatgctgagtatacttttctttcacaaccattgcaaacccaggtagccctggagttttctttttttctcatcatcattgttttgttttttttatggttcaagacttttgcaatacatgaattaaaaataagcagttctttaaagcatagcgctctaaaaactattcttagtttataccctcaaaagttgggtctttcatgaaacacagtggtttgaatatgaacaccagtagcattctcgttcgttgttagggtaagagagttttgtagaatgatctccaaaagaagcagtcctcaaaaggcatttaccagtgatatcttttaatattcatgtttttatttaatgatgtaagatagaattaataaactactaaggaaataagccaatgtggttattgtactcaatttcgtttttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagaatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatagttttaactctcctagatcttcttttagagtgtttttatgagtgtttaatgtaggaatgtgtatatattatctacagccacaggaaatgtatagttacgatttttacatacgtgtatgtatattattgtacaacttgctatttctacttgggagttttttattttggtacattcacatttacctaatctcttgtgcactgtccaacagtactttgcctataatagacacttaaggaagttttccttctttttattcctttataattacaaacaatgctgaaaggaacatcatcctacatgagccctttttgtacatataaggctctctctgtggtatatgcttaggatttgaatttcaggccagagtataaccatttttaatttgaagagatacttccatttgggttccagaatggctgtatcaagttacagttcccctgagcaagatatgagcatctgcttccccatgtaattaatgacacttgctattggatttttgtaatttaattactctgaaaaaattattttggttttaaatcagaaatttctcactagtgaagatggacatatttttgtatgtttattttagaacatataaacatttgttaattttctttttcctctcatttttctattgaatgatttgtccttttatctcatggatttgttaggagttctcttgtattttctgtattttatgtctgttgccaatgttttctcctacttagccatttggctttaattttacatggtgtctgtttaaataaatgttttatatttgtatacaatcaaattgattaattttcatgacttatttcaggatataaagcaaattattttctaagacatttacagtgtatgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgttctcagatttgggtaaagccttcctcatgttctataaaaattggttaactgctggtgagcacatctcttgaagttttgatatgggttgcacaacatttataggactgatttggagagaccgacaataccgagtgcagtcctcccttggtatctagttccaggacccctgtggataccaaaatccaagcaatgccctgcagatcatgggacctatgcatatgaaaagtcggtccttgtatttgagggttttgcatccctcaaataccatatgttttatttgtgtttggttgaaaaaagtttgcatataagtgaaacttagcatttcaaacctgtgttgttcaaagatcatttgtatttctcttcaagaacaatgaatgtcttcattaaatcatcttttgtgggagagcttttggtttcatagattttcatatatatatatgatataataaacactttttgacattc

SEQ ID NO: 34370 - DNA, 2922 bp, Homo sapiens
ctttatgtgttgcactgagggcagtctccggaaacgcgattcgcagcgggcgccggaagcggtgttgtgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgttcagaaacttagtctggttgcagtaagtaattctgttccacaggatatctgctgtatggcagctgatggcagattagtctttgctgcttatggaaatgttttctctgcatttgcccgtaataaagagatagtacatacctttaagggtcataaggcagaaatccatttcttgcaaccctttggagaccacattatctctgttgatactgatggcattcttattatttggcacatatattcagaagaagaatacctgcagttgacttttgataaatcagtatttaaaatttctgcaattttgcatccaagtacctacttgaataaaatacttctgggcagtgaacaaggaagcctgcagttgtggaatgtaaaatccaataaacttctatatacatttccaggatggaaagttggagtgacagctcttcagcaggcaccagccgtggatgttgttgctattggtcttatgtcaggtcaagttatcattcacaacattaaatttaatgaaacattaatgaagtttcgtcaagactggggacccattacttcaatttcatttcgcacagatggtcatccagtaatggcagctggaagcccatgtggccatattggactctgggatctagaagacaaaaaattaatcaaccaaatgagaaatgcacactctacagcaattgccggactgacatttctccatagagagccacttcttgtcacaaatggcgctgacaatgctcttaggatatggatatttgatggtcctacaggtgaaggccgacttttgagattcagaatgggtcatagtgctcctcttaccaatatcagatattatggacagaatggacagcagattctaagtgcaagtcaagatggaactcttcagtcattttccacggtacatgaaaaattcaataagagcttgggacatggattaataaataaaaagagagttaaacgtaaaggacttcagaataccatgtcagtgagacttccacccatcacaaagtttgcagcagaggaagctcgtgaaagtgactgggatggtatcattgcttgccatcaaggtaagctatcttgctcaacctggaattatcagaaatctacaataggcgcttactttctcaagccaaaagagttgaagaaagatgacataactgcaacagcagtggatataacttcttgtggaaactttgctgtaattggcctctcatcaggaactgtagatgtatataacatgcagtctggcatacatcgaggaagttttggcaaggatcaagctcacaagggatctgttagaggtgtcgcagtggatggattaaaccagttgacagttacaactggtagtgaaggattactcaaattctggaactttaaaaacaaaattttaatccattctgtgagcctcagttcatctccaaatatcatgttgctacatagggacagtggcattctgggactcgccttggatgacttctccattagtgttctggacatagaaactaggaagattgtcagagagttttctggacaccaaggccaaataaatgacatggcttttagtcctgatggtcgttggttaataagtgctgcgatggattgctctattaggacttgggaccttccttctgggtgccttatagactgctttttgttggactcggctcctctcaatgtttctatgtctcctactggagactttctggcaacttcccatgtggaccaccttggaatttatctatggtccaatatttccctgtattcagttgtttcattacggccacttcctgcagattatgtcccttcaatagtcatgcttcctggtacttgtcaaacccaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttctt

SEQ ID NO: 34371 - DNA, 1471 bp, Homo sapiens
ctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggaccgtggcaaggaggtgtacagccctgactttcatagcctcggaggagaaggtcttggtggccgacaagtctggagacgtctactccttttcggtgctggagccacacgggtgtggccgtctagagctggggcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactgagtctgtgtagtaaatttttgactaggaa

SEQ ID NO: 34372 - DNA, 2122 bp, Homo sapiens
gtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggaccgtggcaaggaggtgtacagccctgactttcatagcctcggaggagaaggtcttggtggccgacaagtctggagacgtctactccttttcggtgctggagccacacgggtgtggccgtctagagctggggcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtcagtggtgtctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtccgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgaatgcttgagcctgccccagccccagccgtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaaccgaatataccaggcaaaactc

SEQ ID NO: 34373 - DNA, 3707 bp, Homo sapiens
aagtgacgtcggagtgtcaacatgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggc

SEQ ID NO: 34374 - DNA, 3610 bp, Homo sapiens
aacatgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagtaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggc

SEQ ID NO: 34375 - DNA, 2140 bp, Homo sapiens
aacatgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggtaagagttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtat

SEQ ID NO: 34376 - DNA, 2864 bp, Homo sapiens
aacatgcaagatggcggcccatcaccggcagaacacagcagggcggaggaaagtgcagtgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatgggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggc

SEQ ID NO: 34377 - DNA, 746 bp, Homo sapiens
cttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgcctttaccctatacctctctgcacgtcccaccccattttgctgtgtgctcacccccaggatgtgtacccggttgtagtaggagctgaaatccatgctgagctgtaccagaataaagaatagagtgtagagtgt

SEQ ID NO: 34378 - DNA, 4401 bp, Homo sapiens
tttattgtgtactgactccatctgccccgtcaaataaaaaaccacaaggttcgagccgccgggcccgacaaactccgggtcggcgaaacagagtccgcgataggtgcagcgggctggcagctgggagcgccccgcaagcgtcacgtgagggggcgaggggcgggatgcccctccgcgggccccgccaatgatgagctggattgcgtgggacgaagggtcgtcattggacaaccgccgcgggcgccctggtctctgctacctgtagctgagggcgctgttgatgggcagcgcggcgcgctgggaaggctcgttctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggatgggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccattttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtc

SEQ ID NO: 34379 - DNA, 3377 bp, Homo sapiens
aaaaggggtgccctgaggagaaggacgggcagcaggttgaggccgatcggaggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagca

SEQ ID NO: 34380 - DNA, 4557 bp, Homo sapiens
atggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaataccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggcttggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttacagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactga

SEQ ID NO: 34381 - DNA, 1980 bp, Homo sapiens
tttcccgcggctgttcgctgttccagtgggtcgtggcggtggcggcagcggcggttaggggatgtaacggtcgcccgcctccggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggccctgtcctaggtgctgaggacacagacacaaaatccctgcccttaacaagctcacatttggatgggaaaggaaacctggaaacatcatcagtgaataacacgccaagcagcagtaaccctctgaagaaaaatgaggcggggaaggggaaggggaatgcaggtggtattctagagaggagaggggtcagggaaggcctccctgaggacatatgagcagagacctgcaggaaatcggggagtgagacctgcaactgctggggagaaccacaagcacagaggccctgcggcaggaacatgcactccacagagagctttgctgtggaggtcgtttatgtatttcactgctttttttaaaaaggagttgaagacggggcatggtggctcacacctgtaatcccaacactttgggaatctgaggcgggaggatcacttgagtccaggagtttgagaccagcctgggcaacacaagaccctgtctctacaaataatttttaaaaattagccaggcatggtagcacacacgtgtggtcccagctactcaagaggtggaggcaggaagatcacttgagcctgggatgtcaaggctgcagtgagctgtgattgtgccaccacactcccacactccagcctgggtaacagtgagaccatgtctag

SEQ ID NO: 34382 - DNA, 1543 bp, Homo sapiens
tttcccgcggctgttcgctgttccagtgggtcgtggcggtggcggcagcggcggttaggggatgtaacggtcgcccgcctccggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaatttggctcctgctctgcagatgtgtggacgtggccactcccggcagcccaacacacccagcccaggtgaaattgcttcctaa

SEQ ID NO: 34383 - DNA, 4745 bp, Homo sapiens
tttcccgcggctgttcgctgttccagtgggtcgtggcggtggcggcagcggcggttaggggatgtaacggtcgcccgcctccggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaataccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggcttggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagagctcttccccgcagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttacagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaggaatg

SEQ ID NO: 34384 - DNA, 1299 bp, Homo sapiens
ggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggaatgtggagaatggggcctgcctctgagagctgtggagaggattccatagccccctctctgtctagaacagttcctggcatgtactgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggag

SEQ ID NO: 34385 - DNA, 3037 bp, Homo sapiens
acttccggtttgtcgttgctataggaaccgctacggcgtttgaaagtgtccgggttgcttaggatccctacaggtagcgcctctggatacatgcgtggtctgctgacccagagagaaacgaaagcagaactgtttggcgggagatcatgtcagccgtggtagctcagacgctgcatgtttttggtcttcgatcccacgtggccaacaatatcttctacttcgatgaacagatcattatatttccttcaggaaatcactgtgtgaagtacaatgtggatcagaaatggcaaaaattcattccaggctcagagaagagtcagggcatgttggccttgtccatcagtcccaatcggcggtacctcgctatctctgagactgtgcaagaaaaacctgccatcaccatttatgaattgtcatccatcccttgccggaagcgcaaagttcttaataattttgacttccaagttcagaaatttattagcatggctttttctccagactccaaatacctattggctcagacgtcacctccagagtcaaatcttgtctactggctgtgggaaaaacagaaagtaatggccattgttagaatcgacactcagaacaaccctgtctaccaggtgagcttcagtccacaggataacactcaggtgtgtgtcactggaaatgggatgtttaagcttctccgttttgctgagggaaccctgaagcaaaccagctttcagaggggagaaccccaaaactatctagctcacacctgggtggctgatgacaagattgtcgttggcactgacacaggcaaactcttcctctttgaatctggagatcagcgttgggagaccagcataatggtcaaggaacctaccaatggctcaaagagcctggatgtcattcaggaatcagagagcctgattgaatttccaccagtcagttctccactcccttcctatgaacagatggtggcggccagtagccatagccagatgtccatgccccaggtgtttgccattgcagcctattcaaagggatttgcctgttctgctgggccagggagagttctgctgtttgagaagatggaagaaaaggatttttaccgtgagagcagagaaatcaggattcctgtggacccgcagagcaatgatccaagtcagtctgacaaacaggacgttctctgcctgtgcttcagcccctcagaggaaactctggttgccagcaccagtaagaaccaactctacagcatcaccatgtccctgacagagatcagcaagggggagcctgctcactttgagtatttgatgtatccattgcactcagcacccatcaccggtctagctacctgcatccgcaaaccccttatagccacctgttctctggatcgatccatccgcctttggaattatgaaacaaacaccctggaactatttaaggaataccaagaagaggcatattccatcagccttcatccatctggacacttcattgtagtagggtttgctgacaaactacgcctcatgaatctactcattgatgatatacgttctttcaaagaatactctgttagaggatgcggagagtgttcctttagcaatggaggtcacctgtttgctgcagtcaatggaaatgtgattcacgtttacaccaccacgagcctagagaacatctcaagcctgaaaggacacacagggaagattcgctcaattgtgtggaatgcagatgatagcaaactgatttctggtggcacagatggtgctgtgtatgaatggaatctgtccacaggaaagagagagacagaatgcgtgctcaagtcttgcagctacaactgtgttactgtctcccccgatgccaaaattatctttgctgttggatcagaccacaccctcaaggagattgcagattccttgatccttcgagagatatcggcgtttgatgtcacctacaccgccattgtcatctcgcattctggacgcatgatgtttgtgggcacctcggtgggaaccattcgtgccatgaagtaccctctgcctctgcagaaggaattcaatgagtaccaggcccatgccggtcctatcaccaaggtgagcagggccctctccccaggaacccagtcccacacctgcctgctacgtgccttgttcatcccttcaacctcccaatgtcttttctctctccttcttctctcttatttattcatccatcattcattgaatcaccatctattgactatgaatatactctttgtttaaactacttccaggaatttagcctaggaaatcatcagagatacacctaaaaatgtatgtacaacgttttcaccataatattatgcataataaggggccgtttggtggatgccgtagctgccgtgagtgtgggctgcacttgaccacagctgcctcctcctccagagaatgccccagactgaaaggagccatagccctgaagattggcccctacctctccctgagggtacaaaaggccaccccaggggcaataccatgagtacacatttgtaaattgtccttccattcacccttctcataaagtagtatctatgttcaacagtcaaaatgtggaagcaaccaagcatccatcgacagacgaatgcataagcaaaagatggtatatctatacaatggaacaataccctgcctaaaaaggaagggaattctgcaatgtgctaccacatggatgaaccttgaggatgttatgctaaattaaataaggccaaccacaaaaagataagtacagtgtgattccacttttaggagatacttggagcagtcagaatcacaaagacagagtggtggttggcaggggctgcaggaagggggaatgaggaatgattgtttcataggtatagagttttggttttacaagacaaaaggattatgggggtagttggtggcaatggctgcacaacattacaaatgtatttaataacatgaactgtacacttgaaaatggttaagatagcaaattttacagaatatgtattttacgacaattttaaaaatgaaataaaaaagaattatcttgc

SEQ ID NO: 34386 - DNA, 576 bp, Homo sapiens
gttgctataggaaccgctacggcgtttgaaagtgtccgggttgcttaggatccctacagaactgtttggcgggagatcatgtcagccgtggtagctcagacgctgcatgtttttggtcttcgatcccacgtggccaacaatatcttctacttcgatgaacagatcattatatttccttcaggaaatcactgtgtgaagtacaatgtggatcagaaatggcaaaaattcattccaggctcagagaagagtcagggcatgttggccttgtccatcagtcccaatcggcggtacctcgctatctctgagactgtgcaagaaaaacctgccatcaccatttatgaattgtcatccatcccttgccggaagcgcaaagttcttaataattttgacttccaagttcagaaatttattagcatggctttttctccagactccaaatacctattggctcagacgtcacctccagagtcaaatcttgtctactggctgtgggaaaaacagaaagtaatggccattgttagaatcgacactcagaacaaccctgtctaccaggtgagcttcagtccacaggataac

SEQ ID NO: 34387 - DNA, 9074 bp, Homo sapiens
ggcggcaccggcaccttgcagtatcactggggagacggcggctgtatagcgcttgccgccccacggattatcccagcaggatctacgcaccccgcatcctccgtagttccgccctatccttgtcctccttggctggggcgcccaccggcggtctgataggctacatcgcggcatgagatgaagctgtgacaggtttgaaaacacaaacacaatggcaggaaacagccttgttctacccattgttctttggggtcgaaaagcgcccacacattgcatctcagccgtacttttaacagatgatggggccacgatcgtaacaggatgtcacgacggacaaatatgtctctgggatctttcagtagaactgcaaattaatcctcgagcactgttgtttggtcatacagcatcaatcacttgtttgtctaaagcttgtgcttccagtgacaaacagtatattgtgagtgcatctgaaagtggagagatgtgcctctgggatgtgagtgatggcagatgtattgaatttacaaaattagcttgcacacatactggcatacagttctaccagttctctgttgggaatcagcgagaaggaaggcttttatgccacggacattaccctgaaatccttgttgtggatgctaccagccttgaagtattatactccttagtatcaaagatatcaccagactggattagctccatgagtattattcgatcccaccgaacacaagaggacacagtggtagcactctcggtgactggcatcctgaaggtctggattgttacctcggaaataagtgacatgcaggatactgagccaatatttgaggaggaatccaaaccaatttattgtcagaattgccaaagcatctctttttgtgcatttacacaaaggtcacttttggttgtgtgttccaaatattggagggtgttcgatgccggagactattccttgttgtgttcaggtcctagtgaaaatggacagacatggaccgggggggactttgtctcatcagataaagtcatcatttggacagaaaatgggcaaagttatatttacaaactacctgccagttgccttccagctagtgattcattccgcagtgatgtggggaaggcagttgaaaatttaattcctcctgtacaacatatcctcttggatcgaaaagataaagagttgctaatttgtcctcctgttactcggttcttctatggatgcagagaatatttccataaactgttaattcagggtgattcttctggaaggttgaatatttggaacatatcagacacagctgataaacagggaagtgaagaagggctggcaatgacaacttctattagtttgcaagaggcatttgataaactgaatccttgtcctgctggaattatagatcagctgagtgtgattcccaatagtaatgaacctcttaaagtaactgcaagtgtgtacataccagcacatggacgacttgtttgtggtcgtgaagatggaagcatagttattgtacctgccacacagacggccatagtacagctgttgcaaggggaacacatgctcagaagaggttggccacctcacagaacactccgtggtcatcggaacaaagtcacatgtttgctatatcctcatcaggtctcagctcggtatgatcaaagatacctgatatctggaggtgtggatttttcagtcataatttgggacatattttctggagaaatgaaacatatcttctgtgttcatggtggtgagattactcaacttctagttccacctgaaaactgtagtgcaagagtacagcactgcatctgctctgtagccagtgaccactcagtaggacttctaagtttgcgagagaaaaaatgcataatgttggcatctcgtcacctttttcctattcaagtaatcaaatggaggccttctgatgattacctggtggtggggtgttcagatggttctgtgtacgtctggcaaatggatactggtgcattggatcgttgtgtgatggggataacagcagttgagattctaaacgcttgtgatgaagctgttcctgctgctgttgattcacttagtcatccagcagtcaacctaaaacaagctatgacgagacgtagtcttgctgctcttaaaaatatggcccatcataagctacaaacccttgcaactaacctcttggcttctgaggcatctgacaagggaaatttacctaaatattctcataactccctgatggttcaagcaataaagacaaacctaacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaagttgctgcacctgtcgtttccgctcggtctgatgctgatcactctggctctgaccctccttctgctcctgctttacatacctgtttcttagtaaatgaaggttggagtcagttagctgctatgcactgtgttatgctgccagacctactgggattggataaatttaggcctccccttctggagatgctggcccgaagatggcaagatcgatgcttggaggtgagagaagccgcgcaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactggttgcttatcaagtgtcccacaaatgaaaaaaatttctacatcttacgaggaaagacggaagcaagctaccgctattgttttacttggagtaataggagctgaatttggtgctgaaattgaacctcctaaactattgaccagacctcgaagctctagccaaattcctgagggattcgggttgactagtggtggatccaactactcgctggccagacatacttgcaaggcactgacgtttcttctgctacagcctccaagccccaaacttcctccacacagcactatccgaagaacagccattgatctgattggacgtgggttcactgtttgggagccttacatggatgtgtccgctgttctgatggggcttctcgaactttgtgccgatgccgagaaacaacttgccaacatcacaatggggttgcctctgagcccagcagctgactcggcccgctctgcgaggcatgccctctcgctcattgccaccgccagaccacccgccttcatcaccaccatagccaaagaggtacacagacatacggctcttgcagcaaatacccaatcacagcagaatatgcacacaacaactcttgcacgagctaaaggggaaattttgagagtcattgaaattcttattgaaaagatgcccacagatgttgtggatcttctcgtggaggttatggacatcattatgtactgccttgaaggatctttagttaaaaagaaaggtcttcaagaatgtttcccagccatctgcaggttctacatggtcagctattatgagcggaatcacagaatagcagttggagctcgccatggttcagtggccctgtacgacatccggactggaaaatgtcagacaatccatggacacaagggaccaatcactgcagtggcttttgctcctgatggaagatatcttgccacctactcaaacactgacagccacatttctttttggcagatgaacacgtcactgctgggaagcatcggcatgctgaactcggcacctcagctgcgctgcattaaaacctaccaggtgccccctgtgcagcccgcgtcccccggctcccacaatgccctcaagctggcccggctcatctggacttccaaccgcaacgtcatcctcatggcccatgacgggaaggagcaccgcttcatggtctaatgctgctgcctgccgccgtgactgcgttttagttctctaaattatccaagccgatgttgctctgtccttcctcacaccagattgttcccaggggcctgcccaccccagtgccatccagtggcacggccgggtcttgtcacttgtgcatgcttctcaggggcagaacccgctcgtgccatctgtcgattcagaggcacgcacacatgctctgcaggatgtggccatcctgtcaccaggtagtttttccctgccagagatggcaggggaaagccagtggttcctgggaacgctcttgttgcttggtgcaacagaagcacaaaaatcaataaacactgtgattgcactcccagcccagatcagcatttttagccatctcaaccgcacctctgaagtgctgcttgaatctggccgttctgacactgggtgttgaggtcatgtggcagtcctcacgattgaaattattgccctttgaattacctaaaatattgtttaccaaaaagattctgtgtttacatgttcttttcttctggtgattgctaggaaattactcaatccaatttcctagggtttagctaccaccttctttatcaacagctaaccaatttgagattcatgattaattatgtacacaaaaatattttccttgtagaaaatagttttccagacacttagccttctgaagtgctcatctcttgcttaaatgatagtctatttagtagtttaaaataaaaataatcactccctatgatctagttaatgtaattatccagtcactgtaactaatctcttgaagggacttttgtgataaagagccaagttcagaagcatagcgtgtaccgaaaatgaagactctcctatctactgctacagatcctgttgaagaaagagcttacccctttcccccggaaaacttgcaatcctgtagttcccatatgtgtggcatatgtcagttatgaaattattataattcagccttcaaactactactgatcaactaaaggaaagctaataaggtatttcttttaaacaagtattctggaaaagtaataactatggcacaaatgttcaggagtgtatataaaaatatgtgggctctcgatttatttgagcaaacattgcaatgagggtgttcattatgcttctaagtaagctttaactagaccactttcttcttatgtcagattgtgctggttctagctcataataatgaaaaaaatagaattatattttgtatgaattgtttctaacaaaccttgatctgtatatacttgtgaggggttgtttggttgcctaattgttgattggttggttagttgggcaaaatcatttattacatgcaaaaatagaaaattatttgttaaattcagagaaaatatgtgaagtttacaaaggaaccaaaatgataatgggagaatttagtcttaaaagtttaggttgtcagagtttatctgatatacaaaaaagtaggatcaaagtctaggaacaaacattggttatttcactgaaacagatttttaaagagcatattaagaaattaagaccattagatcatctctttcataatgatatgatgttatttccattgacggcaaatctatactgttccttggttttagagttgggtattctttcaaaagtgaatttaggcacatgcatgtacattgtatttataaagattatatatgtagtttccaaggaagaaacaaagacctatacagtttagactttatttgtttggtgaacgtgctgttgtgtttggcatagctagagaaatgtaaggtaaaaggctcactttgttttccagtgggtccagagtcttctctatacccaacatatgtttactttatgaacttaaatggaaattaatttattgtagactacatctctatttggaatgatgaggtaaatgtataccttagcattttctttaacaaaaatgttctgtgtgtcaggaaagaggtgtgagagtggtaggcagcctgccgcaaacacacggatggctccccccgccacgaaggttgagaacaaagccagggggcccagaggagcaatagccctgggccacaagcgtgggtaggcctttcacgtattccgtctgcacaggcaaccaaggccagtagaaagctatggctgcaaaaccctggggtggacgatgtttgatgattagacggtcatctctaactactaaactaatatctgcattcttgttaacataaatctctccttggctattttaatagccacagtcccaaacttcatcccagcttagatttctcagcactgaggtaaactctgcattgtcatcccagcgtacacctttaatgttttattgatttcactggcactgtatttggacctgtccttgtatatgtagagacatatgtggcttcattggtaatttacaagcaaaagatgacatgacgtgacacctgtatgaaaatgtgatgattgaactccctgtgtacagcgagtgaattaaaatgtctgcctctccagacatttcttaatgattccacttaatagactctatgtgtgctgaatgttcctgtgtacatatgtgtgttaaataaaacaattgtattgaagactgtttttctcacaatattaccttttccagtgttcactcatcttaaacatcctcagttgaaatccgtatgctccgctagccctgctgcttctaatcattcatttccctggagagctggcttgggaaaggcaacttattcccagaggacagtagagcagaagtgcagaggtaagctctccctccagaaactcactggcactctctgtggtttgggaaaggcgttgcatgcctgttgctttatctctactctacatgctcccaaatagactggtaatggcaccaaatcatatcttgtcagattggatggcatgggttggctgcctctcgggagctaggctgagatcatcaagttcattgcatttcacgctcagtttggagtcgaatttgaatccctcaggtaaagggtataattggttttcagaaaaatcaagaataataaaataggtccttactgctcatagagggttatgtgtaagtagtgaatgtacttcttgtctcttaattatttcagataagaacacaaaagcttgatttgagtcaatcatcgtgtaacagtataattttctgtaagaattcggtgaacattccaggagtggtctgaggcatcttgggccctattaaatgcccactgtgggccccaggaaatgttttaacatctcatgacttaaatgtattcttatagggaaaataggggcagtaacagttctatatgatcagcgatcacataaactgatcaaatgtggaaaggcgtgacgttaataggaaggtaaagccaagcagtgctgggtgaactttcacctttcaccccttcggctgactgacagagcccagtgttgaagaaaatcaatactttggagccaggagggaaatacttccaccctctaactagagaatgtgttttgacaaggccaagataatccaagctgcacaggagaaagagaaaagaagactcatttttaaagcctgacacttcaaggtgtttttgtgcaatggtttagagatcgtcaatacatacaaataccaaaggtcaaaaagaaaagccagaagaatttcaaaaattagatgttcagttctttttgctgtttaaaaaaaaaaaaaaaaggactacagagagttttgtgcttgtaattgtccttttaatgaactaagctcacaattgtgtgaccattgaggtgatcatccctctttaatcaaaacttacatttttgtagcagcagaacgatgaatattgaatgctcaaaaagcattcagacttcctgcttctgtacaccttttggctacagattgttttgttttgttttgttttgtttttttgagtggttacattgttttgtgctaacatctcagaatttggttttgcaattcatgttgattctgccataatggcattgtaaatcctggatcctccttcacattcagttcaatcctttgcatgagaaaagagttcttgtacctagaacttaattttttttctagtttcccaagtccctttaagcaaattacttatgaagatattctaattaatgtctctctgagtgagaggtttatgcacctctaggaagatggtaaacaattcattcttaccagcaagattagagccattcattctgtagacaaatacctccatcaagtggatatagattctttgctttcctactgataagaaaactaagaagccagtggtgcccatacctgccagacaagctcagaaggacaaaggagtcttaagtatctaaagtacatcatcaggcctgctgtaaacatgtgctaattaaagagtattaaaaatatagtgaaaatata

SEQ ID NO: 34388 - DNA, 7183 bp, Homo sapiens
ggcggcaccggcaccttgcagtatcactggggagacggcggctgtatagcgcttgccgccccacggattatcccagcaggatctacgcaccccgcatcctccgtagttccgccctatccttgtcctccttggctggggcgcccaccggcggtctgataggctacatcgcggcatgagatgaagctgtgacaggtttgaaaacacaaacacaatggcaggaaacagccttgttctacccattgttctttggggtcgaaaagcgcccacacattgcatctcagccgtacttttaacagatgatggggccacgatcgtaacaggatgtcacgacggacaaatatgtctctgggatctttcagtagaactgcaaattaatcctcgagcactgttgtttggtcatacagcatcaatcacttgtttgtctaaagcttgtgcttccagtgacaaacagtatattgtgagtgcatctgaaagtggagagatgtgcctctgggatgtgagtgatggcagatgtattgaatttacaaaattagcttgcacacatactggcatacagttctaccagttctctgttgggaatcagcgagaaggaaggcttttatgccacggacattaccctgaaatccttgttgtggatgctaccagccttgaagtattatactccttagtatcaaagatatcaccagactggattagctccatgagtattattcgatcccaccgaacacaagaggacacagtggtagcactctcggtgactggcatcctgaaggtctggattgttacctcggaaataagtgacatgcaggatactgagccaatatttgaggaggaatccaaaccaatttattgtcagaattgccaaagcatctctttttgtgcatttacacaaaggtcacttttggttgtgtgttccaaatattggagggtgttcgatgccggagactattccttgttgtgttcaggtcctagtgaaaatggacagacatggaccgggggggactttgtctcatcagataaagtcatcatttggacagaaaatgggcaaagttatatttacaaactacctgccagttgccttccagctagtgattcattccgcagtgatgtggggaaggcagttgaaaatttaattcctcctgtacaacatatcctcttggatcgaaaagataaagagttgctaatttgtcctcctgttactcggttcttctatggatgcagagaatatttccataaactgttaattcagggtgattcttctggaaggttgaatatttggaacatatcagacacagctgataaacagggaagtgaagaagggctggcaatgacaacttctattagtttgcaagaggcatttgataaactgaatccttgtcctgctggaattatagatcagctgagtgtgattcccaatagtaatgaacctcttaaagtaactgcaagtgtgtacataccagcacatggacgacttgtttgtggtcgtgaagatggaagcatagttattgtacctgccacacagacggccatagtacagctgttgcaaggggaacacatgctcagaagaggttggccacctcacagaacactccgtggtcatcggaacaaagtcacatgtttgctatatcctcatcaggtctcagctcggtatgatcaaagatacctgatatctggaggtgtggatttttcagtcataatttgggacatattttctggagaaatgaaacatatcttctgtgttcatggtggtgagattactcaacttctagttccacctgaaaactgtagtgcaagagtacagcactgcatctgctctgtagccagtgaccactcagtaggacttctaagtttgcgagagaaaaaatgcataatgttggcatctcgtcacctttttcctattcaagtaatcaaatggaggccttctgatgattacctggtggtggggtgttcagatggttctgtgtacgtctggcaaatggatactggtgcattggatcgttgtgtgatggggataacagcagttgagattctaaacgcttgtgatgaagctgttcctgctgctgttgattcacttagtcatccagcagtcaacctaaaacaagctatgacgagacgtagtcttgctgctcttaaaaatatggcccatcataagctacaaacccttgcaactaacctcttggcttctgaggcatctgacaagggaaatttacctaaatattctcataactccctgatggttcaagcaataaagacaaacctaacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaaggttggagtcagttagctgctatgcactgtgttatgctgccagacctactgggattggataaatttaggcctccccttctggagatgctggcccgaagatggcaagatcgatgcttggaggtgagagaagccgcgcaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactggttgcttatcaagtgtcccacaaatgaaaaaaatttctacatcttacgaggaaagacggaagcaagctaccgctattgttttacttggagtaataggagctgaatttggtgctgaaattgaacctcctaaactattgaccagacctcgaagctctagccaaattcctgagggattcgggttgactagtggtggatccaactactcgctggccagacatacttgcaaggcactgacgtttcttctgctacagcctccaagccccaaacttcctccacacagcactatccgaagaacagccattgatctgattggacgtgggttcactgtttgggagccttacatggatgtgtccgctgttctgatggggcttctcgaactttgtgccgatgccgagaaacaacttgccaacatcacaatggggttgcctctgagcccagcagctgactcggcccgctctgcgaggcatgccctctcgctcattgccaccgccagaccacccgccttcatcaccaccatagccaaagaggtacacagacatacggctcttgcagcaaatacccaatcacagcagaatatgcacacaacaactcttgcacgagctaaaggggaaattttgagagtcattgaaattcttattgaaaagatgcccacagatgttgtggatcttctcgtggaggttatggacatcattatgtactgccttgaaggatctttagttaaaaagaaaggtcttcaagaatgtttcccagccatctgcaggttctacatggtcagctattatgagcggaatcacagaatagcagttggagctcgccatggttcagtggccctgtacgacatccggactggaaaatgtcagacaatccatggacacaagggaccaatcactgcagtggcttttgctcctgatggaagatatcttgccacctactcaaacactgacagccacatttctttttggcagatgaacacgtcactgctgggaagcatcggcatgctgaactcggcacctcagctgcgctgcattaaaacctaccaggtgccccctgtgcagcccgcgtcccccggctcccacaatgccctcaagctggcccggctcatctggacttccaaccgcaacgtcatcctcatggcccatgacgggaaggagcaccgcttcatggtctaatgctgctgcctgccgccgtgactgcgttttagttctctaaattatccaagccgatgttgctctgtccttcctcacaccagattgttcccaggggcctgcccaccccagtgccatccagtggcacggccgggtcttgtcacttgtgcatgcttctcaggggcagaacccgctcgtgccatctgtcgattcagaggcacgcacacatgctctgcaggatgtggccatcctgtcaccaggtagtttttccctgccagagatggcaggggaaagccagtggttcctgggaacgctcttgttgcttggtgcaacagaagcacaaaaatcaataaacactgtgattgcactcccagcccagatcagcatttttagccatctcaaccgcacctctgaagtgctgcttgaatctggccgttctgacactgggtgttgaggtcatgtggcagtcctcacgattgaaattattgccctttgaattacctaaaatattgtttaccaaaaagattctgtgtttacatgttcttttcttctggtgattgctaggaaattactcaatccaatttcctagggtttagctaccaccttctttatcaacagctaaccaatttgagattcatgattaattatgtacacaaaaatattttccttgtagaaaatagttttccagacacttagccttctgaagtgctcatctcttgcttaaatgatagtctatttagtagtttaaaataaaaataatcactccctatgatctagttaatgtaattatccagtcactgtaactaatctcttgaagggacttttgtgataaagagccaagttcagaagcatagcgtgtaccgaaaatgaagactctcctatctactgctacagatcctgttgaagaaagagcttacccctttcccccggaaaacttgcaatcctgtagttcccatatgtgtggcatatgtcagttatgaaattattataattcagccttcaaactactactgatcaactaaaggaaagctaataaggtatttcttttaaacaagtattctggaaaagtaataactatggcacaaatgttcaggagtgtatataaaaatatgtgggctctcgatttatttgagcaaacattgcaatgagggtgttcattatgcttctaagtaagctttaactagaccactttcttcttatgtcagattgtgctggttctagctcataataatgaaaaaaatagaattatattttgtatgaattgtttctaacaaaccttgatctgtatatacttgtgaggggttgtttggttgcctaattgttgattggttggttagttgggcaaaatcatttattacatgcaaaaatagaaaattatttgttaaattcagagaaaatatgtgaagtttacaaaggaaccaaaatgataatgggagaatttagtcttaaaagtttaggttgtcagagtttatctgatatacaaaaaagtaggatcaaagtctaggaacaaacattggttatttcactgaaacagatttttaaagagcatattaagaaattaagaccattagatcatctctttcataatgatatgatgttatttccattgacggcaaatctatactgttccttggttttagagttgggtattctttcaaaagtgaatttaggcacatgcatgtacattgtatttataaagattatatatgtagtttccaaggaagaaacaaagacctatacagtttagactttatttgtttggtgaacgtgctgttgtgtttggcatagctagagaaatgtaaggtaaaaggctcactttgttttccagtgggtccagagtcttctctatacccaacatatgtttactttatgaacttaaatggaaattaatttattgtagactacatctctatttggaatgatgaggtaaatgtataccttagcattttctttaacaaaaatgttctgtgtgtcaggaaagaggtgtgagagtggtaggcagcctgccgcaaacacacggatggctccccccgccacgaaggttgagaacaaagccagggggcccagaggagcaatagccctgggccacaagcgtgggtaggcctttcacgtattccgtctgcacaggcaaccaaggccagtagaaagctatggctgcaaaaccctggggtggacgatgtttgatgattagacggtcatctctaactactaaactaatatctgcattcttgttaacataaatctctccttggctattttaatagccacagtcccaaacttcatcccagcttagatttctcagcactgaggtaaactctgcattgtcatcccagcgtacacctttaatgttttattgatttcactggcactgtatttggacctgtccttgtatatgtagagacatatgtggcttcattggtaatttacaagcaaaagatgacatgacgtgacacctgtatgaaaatgtgatgattgaactccctgtgtacagcgagtgaattaaaatgtctgcctctccagacatttcttaatgattccacttaatagactctatgtgtgctgaatgttcctgtgtacatatgtgtgttaaataaaacaattgtattgaagactgtttttctc

SEQ ID NO: 34389 - DNA, 6978 bp, Homo sapiens
atggcaggaaacagccttgttctacccattgttctttggggtcgaaaagcgcccacacattgcatctcagccgtacttttaacagatgatggggccacgatcgtaacaggatgtcacgacggacaaatatgtctctgggatctttcagtagaactgcaaattaatcctcgagcactgttgtttggtcatacagcatcaatcacttgtttgtctaaagcttgtgcttccagtgacaaacagtatattgtgagtgcatctgaaagtggagagatgtgcctctgggatgtgagtgatggcagatgtattgaatttacaaaattagcttgcacacatactggcatacagttctaccagttctctgttgggaatcagcgagaaggaaggcttttatgccacggacattaccctgaaatccttgttgtggatgctaccagccttgaagtattatactccttagtatcaaagatatcaccagactggattagctccatgagtattattcgatcccaccgaacacaagaggacacagtggtagcactctcggtgactggcatcctgaaggtctggattgttacctcggaaataagtgacatgcaggatactgagccaatatttgaggaggaatccaaaccaatttattgtcagaattgccaaagcatctctttttgtgcatttacacaaaggtcacttttggttgtgtgttccaaatattggagggtgttcgatgccggagactattccttgttgtgttcaggtcctagtgaaaatggacagacatggaccgggggggactttgtctcatcagataaagtcatcatttggacagaaaatgggcaaagttatatttacaaactacctgccagttgccttccagctagtgattcattccgcagtgatgtggggaaggcagttgaaaatttaattcctcctgtacaacatatcctcttggatcgaaaagataaagagttgctaatttgtcctcctgttactcggttcttctatggatgcagagaatatttccataaactgttaattcagggtgattcttctggaaggttgaatatttggaacatatcagacacagctgataaacagggaagtgaagaagggctggcaatgacaacttctattagtttgcaagaggcatttgataaactgaatccttgtcctgctggaattatagatcagctgagtgtgattcccaatagtaatgaacctcttaaagtaactgcaagtgtgtacataccagcacatggacgacttgtttgtggtcgtgaagatggaagcatagttattgtacctgccacacagacggccatagtacagctgttgcaaggggaacacatgctcagaagaggttggccacctcacagaacactccgtggtcatcggaacaaagtcacatgtttgctatatcctcatcaggtctcagctcggtatgatcaaagatacctgatatctggaggtgtggatttttcagtcataatttgggacatattttctggagaaatgaaacatatcttctgtgttcatggtggtgagattactcaacttctagttccacctgaaaactgtagtgcaagagtacagcactgcatctgctctgtagccagtgaccactcagtaggacttctaagtttgcgagagaaaaaatgcataatgttggcatctcgtcacctttttcctattcaagtaatcaaatggaggccttctgatgattacctggtggtggggtgttcagatggttctgtgtacgtctggcaaatggatactggtgcattggatcgttgtgtgatggggataacagcagttgagattctaaacgcttgtgatgaagctgttcctgctgctgttgattcacttagtcatccagcagtcaacctaaaacaagctatgacgagacgtagtcttgctgctcttaaaaatatggcccatcataagctacaaacccttgcaactaacctcttggcttctgaggcatctgacaagggaaatttacctaaatattctcataactccctgatggttcaagcaataaagacaaacctaacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaaggttggagtcagttagctgctatgcactgtgttatgctgccagacctactgggattggataaatttaggcctccccttctggagatgctggcccgaagatggcaagatcgatgcttggaggtgagagaagccgcgcaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactggttgcttatcaagtgtcccacaaatgaaaaaaatttctacatcttacgaggaaagacggaagcaagctaccgctattgttttacttggagtaataggagctgaatttggtgctgaaattgaacctcctaaactattgaccagacctcgaagctctagccaaattcctgagggattcgggttgactagtggtggatccaactactcgctggccagacatacttgcaaggcactgacgtttcttctgctacagcctccaagccccaaacttcctccacacagcactatccgaagaacagccattgatctgattggacgtgggttcactgtttgggagccttacatggatgtgtccgctgttctgatggggcttctcgaactttgtgccgatgccgagaaacaacttgccaacatcacaatggggttgcctctgagcccagcagctgactcggcccgctctgcgaggcatgccctctcgctcattgccaccgccagaccacccgccttcatcaccaccatagccaaagaggtacacagacatacggctcttgcagcaaatacccaatcacagcagaatatgcacacaacaactcttgcacgagctaaaggggaaattttgagagtcattgaaattcttattgaaaagatgcccacagatgttgtggatcttctcgtggaggttatggacatcattatgtactgccttgaaggatctttagttaaaaagaaaggtcttcaagaatgtttcccagccatctgcaggttctacatggtcagctattatgagcggaatcacagaatagcagttggagctcgccatggttcagtggccctgtacgacatccggactggaaaatgtcagacaatccatggacacaagggaccaatcactgcagtggcttttgctcctgatggaagatatcttgccacctactcaaacactgacagccacatttctttttggcagatgaacacgtcactgctgggaagcatcggcatgctgaactcggcacctcagctgcgctgcattaaaacctaccaggtgccccctgtgcagcccgcgtcccccggctcccacaatgccctcaagctggcccggctcatctggacttccaaccgcaacgtcatcctcatggcccatgacgggaaggagcaccgcttcatggtctaatgctgctgcctgccgccgtgactgcgttttagttctctaaattatccaagccgatgttgctctgtccttcctcacaccagattgttcccaggggcctgcccaccccagtgccatccagtggcacggccgggtcttgtcacttgtgcatgcttctcaggggcagaacccgctcgtgccatctgtcgattcagaggcacgcacacatgctctgcaggatgtggccatcctgtcaccaggtagtttttccctgccagagatggcaggggaaagccagtggttcctgggaacgctcttgttgcttggtgcaacagaagcacaaaaatcaataaacactgtgattgcactcccagcccagatcagcatttttagccatctcaaccgcacctctgaagtgctgcttgaatctggccgttctgacactgggtgttgaggtcatgtggcagtcctcacgattgaaattattgccctttgaattacctaaaatattgtttaccaaaaagattctgtgtttacatgttcttttcttctggtgattgctaggaaattactcaatccaatttcctagggtttagctaccaccttctttatcaacagctaaccaatttgagattcatgattaattatgtacacaaaaatattttccttgtagaaaatagttttccagacacttagccttctgaagtgctcatctcttgcttaaatgatagtctatttagtagtttaaaataaaaataatcactccctatgatctagttaatgtaattatccagtcactgtaactaatctcttgaagggacttttgtgataaagagccaagttcagaagcatagcgtgtaccgaaaatgaagactctcctatctactgctacagatcctgttgaagaaagagcttacccctttcccccggaaaacttgcaatcctgtagttcccatatgtgtggcatatgtcagttatgaaattattataattcagccttcaaactactactgatcaactaaaggaaagctaataaggtatttcttttaaacaagtattctggaaaagtaataactatggcacaaatgttcaggagtgtatataaaaatatgtgggctctcgatttatttgagcaaacattgcaatgagggtgttcattatgcttctaagtaagctttaactagaccactttcttcttatgtcagattgtgctggttctagctcataataatgaaaaaaatagaattatattttgtatgaattgtttctaacaaaccttgatctgtatatacttgtgaggggttgtttggttgcctaattgttgattggttggttagttgggcaaaatcatttattacatgcaaaaatagaaaattatttgttaaattcagagaaaatatgtgaagtttacaaaggaaccaaaatgataatgggagaatttagtcttaaaagtttaggttgtcagagtttatctgatatacaaaaaagtaggatcaaagtctaggaacaaacattggttatttcactgaaacagatttttaaagagcatattaagaaattaagaccattagatcatctctttcataatgatatgatgttatttccattgacggcaaatctatactgttccttggttttagagttgggtattctttcaaaagtgaatttaggcacatgcatgtacattgtatttataaagattatatatgtagtttccaaggaagaaacaaagacctatacagtttagactttatttgtttggtgaacgtgctgttgtgtttggcatagctagagaaatgtaaggtaaaaggctcactttgttttccagtgggtccagagtcttctctatacccaacatatgtttactttatgaacttaaatggaaattaatttattgtagactacatctctatttggaatgatgaggtaaatgtataccttagcattttctttaacaaaaatgttctgtgtgtcaggaaagaggtgtgagagtggtaggcagcctgccgcaaacacacggatggctccccccgccacgaaggttgagaacaaagccagggggcccagaggagcaatagccctgggccacaagcgtgggtaggcctttcacgtattccgtctgcacaggcaaccaaggccagtagaaagctatggctgcaaaaccctggggtggacgatgtttgatgattagacggtcatctctaactactaaactaatatctgcattcttgttaacataaatctctccttggctattttaatagccacagtcccaaacttcatcccagcttagatttctcagcactgaggtaaactctgcattgtcatcccagcgtacacctttaatgttttattgatttcactggcactgtatttggacctgtccttgtatatgtagagacatatgtggcttcattggtaatttacaagcaaaagatgacatgacgtgacacctgtatgaaaatgtgatgattgaactccctgtgtacagcgagtgaattaaaatgtctgcctctccagacatttcttaatgattccacttaatagactctatgtgtgctgaatgttcctgtgtacatatgtgtgttaaataaaacaattgtattgaagactgtttttctcacaata

SEQ ID NO: 34390 - DNA, 5257 bp, Homo sapiens
ggcggcaccggcaccttgcagtatcactggggagacggcggctgtatagcgcttgccgccccacggattatcccagcaggatctacgcaccccgcatcctccgtagttccgccctatccttgtcctccttggctggggcgcccaccggcggtctgataggctacatcgcggcatgagatgaagctgtgacaggtttgaaaacacaaacacaatggcaggaaacagccttgttctacccattgttctttggggtcgaaaagcgcccacacattgcatctcagccgtacttttaacagatgatggggccacgatcgtaacaggatgtcacgacggacaaatatgtctctgggatctttcagtagaactgcaaattaatcctcgagcactgttgtttggtcatacagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaagttgctgcacctgtcgtttccgctcggtctgatgctgatcactctggctctgaccctccttctgctcctgctttacatacctgtttcttagtaaatgaaggttggagtcagttagctgctatgcactgtgttatgctgccagacctactgggattggataaatttaggcctccccttctggagatgctggcccgaagatggcaagatcgatgcttggaggtgagagaagccgcgcaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactggttgcttatcaagtgtcccacaaatgaaaaaaatttctacatcttacgaggaaagacggaagcaagctaccgctattgttttacttggagtaataggagctgaatttggtgctgaaattgaacctcctaaactattgaccagacctcgaagctctagccaaattcctgagggattcgggttgactagtggtggatccaactactcgctggccagacatacttgcaaggcactgacgtttcttctgctacagcctccaagccccaaacttcctccacacagcactatccgaagaacagccattgatctgattggacgtgggttcactgtttgggagccttacatggatgtgtccgctgttctgatggggcttctcgaactttgtgccgatgccgagaaacaacttgccaacatcacaatggggttgcctctgagcccagcagctgactcggcccgctctgcgaggcatgccctctcgctcattgccaccgccagaccacccgccttcatcaccaccatagccaaagaggtacacagacatacggctcttgcagcaaatacccaatcacagcagaatatgcacacaacaactcttgcacgagctaaaggggaaattttgagagtcattgaaattcttattgaaaagatgcccacagatgttgtggatcttctcgtggaggttatggacatcattatgtactgccttgaaggatctttagttaaaaagaaaggtcttcaagaatgtttcccagccatctgcaggttctacatggtcagctattatgagcggaatcacagaatagcagttggagctcgccatggttcagtggccctgtacgacatccggactggaaaatgtcagacaatccatggacacaagggaccaatcactgcagtggcttttgctcctgatggaagatatcttgccacctactcaaacactgacagccacatttctttttggcagatgaacacgtcactgctgggaagcatcggcatgctgaactcggcacctcagctgcgctgcattaaaacctaccaggtgccccctgtgcagcccgcgtcccccggctcccacaatgccctcaagctggcccggctcatctggacttccaaccgcaacgtcatcctcatggcccatgacgggaaggagcaccgcttcatggtctaatgctgctgcctgccgccgtgactgcgttttagttctctaaattatccaagccgatgttgctctgtccttcctcacaccagattgttcccaggggcctgcccaccccagtgccatccagtggcacggccgggtcttgtcacttgtgcatgcttctcaggggcagaacccgctcgtgccatctgtcgattcagaggcacgcacacatgctctgcaggatgtggccatcctgtcaccaggtagtttttccctgccagagatggcaggggaaagccagtggttcctgggaacgctcttgttgcttggtgcaacagaagcacaaaaatcaataaacactgtgattgcactcccagcccagatcagcatttttagccatctcaaccgcacctctgaagtgctgcttgaatctggccgttctgacactgggtgttgaggtcatgtggcagtcctcacgattgaaattattgccctttgaattacctaaaatattgtttaccaaaaagattctgtgtttacatgttcttttcttctggtgattgctaggaaattactcaatccaatttcctagggtttagctaccaccttctttatcaacagctaaccaatttgagattcatgattaattatgtacacaaaaatattttccttgtagaaaatagttttccagacacttagccttctgaagtgctcatctcttgcttaaatgatagtctatttagtagtttaaaataaaaataatcactccctatgatctagttaatgtaattatccagtcactgtaactaatctcttgaagggacttttgtgataaagagccaagttcagaagcatagcgtgtaccgaaaatgaagactctcctatctactgctacagatcctgttgaagaaagagcttacccctttcccccggaaaacttgcaatcctgtagttcccatatgtgtggcatatgtcagttatgaaattattataattcagccttcaaactactactgatcaactaaaggaaagctaataaggtatttcttttaaacaagtattctggaaaagtaataactatggcacaaatgttcaggagtgtatataaaaatatgtgggctctcgatttatttgagcaaacattgcaatgagggtgttcattatgcttctaagtaagctttaactagaccactttcttcttatgtcagattgtgctggttctagctcataataatgaaaaaaatagaattatattttgtatgaattgtttctaacaaaccttgatctgtatatacttgtgaggggttgtttggttgcctaattgttgattggttggttagttgggcaaaatcatttattacatgcaaaaatagaaaattatttgttaaattcagagaaaatatgtgaagtttacaaaggaaccaaaatgataatgggagaatttagtcttaaaagtttaggttgtcagagtttatctgatatacaaaaaagtaggatcaaagtctaggaacaaacattggttatttcactgaaacagatttttaaagagcatattaagaaattaagaccattagatcatctctttcataatgatatgatgttatttccattgacggcaaatctatactgttccttggttttagagttgggtattctttcaaaagtgaatttaggcacatgcatgtacattgtatttataaagattatatatgtagtttccaaggaagaaacaaagacctatacagtttagactttatttgtttggtgaacgtgctgttgtgtttggcatagctagagaaatgtaaggtaaaaggctcactttgttttccagtgggtccagagtcttctctatacccaacatatgtttactttatgaacttaaatggaaattaatttattgtagactacatctctatttggaatgatgaggtaaatgtataccttagcattttctttaacaaaaatgttctgtgtgtcaggaaagaggtgtgagagtggtaggcagcctgccgcaaacacacggatggctccccccgccacgaaggttgagaacaaagccagggggcccagaggagcaatagccctgggccacaagcgtgggtaggcctttcacgtattccgtctgcacaggcaaccaaggccagtagaaagctatggctgcaaaaccctggggtggacgatgtttgatgattagacggtcatctctaactactaaactaatatctgcattcttgttaacataaatctctccttggctattttaatagccacagtcccaaacttcatcccagcttagatttctcagcactgaggtaaactctgcattgtcatcccagcgtacacctttaatgttttattgatttcactggcactgtatttggacctgtccttgtatatgtagagacatatgtggcttcattggtaatttacaagcaaaagatgacatgacgtgacacctgtatgaaaatgtgatgattgaactccctgtgtacagcgagtgaattaaaatgtctgcctctccagacatttcttaatgattccacttaatagactctatgtgtgctgaatgttcctgtgtacatatgtgtgttaaataaaacaattgtattgaagactgtttttctc

SEQ ID NO: 34391 - DNA, 5887 bp, Homo sapiens
cctctgccgctcctccgccccacggctcaggattcgcccaaaatgaggacttccctgcaggcagtggcactctggggacagaaggcccctccccacagcatcactgccatcatgatcactgatgaccagcgaacgattgtgactggaagtcaagagggtcagctctgtctctggaatctctcacatgaactaaagatttcagcgaaagaactcctatttggtcattcagcttcggtaacatgtttggcaagagcaagggacttctctaaacagccctacattgttagtgctgctgaaaatggggagatgtgtgtttggaatgtcaccaatggacagtgcatggagaaggctacacttccttacaggcacactgcaatctgttattaccactgctcattccggatgacaggagaaggctggcttctttgttgtggagaatatcaagatgtccttataattgatgccaaaactttggctgttgttcacagttttagatcatctcagtttcctgactggatcaactgcatgtgcattgttcactccatgagaattcaagaagattctctcttggtggtatcagtagctggtgagctcaaagtatgggatctttcctcatctatcaacagcattcaggaaaagcaagatgtctatgaaaaagaatccaagtttcttgagtccttgaactgccagacaattcgattttgcacatatactgagagacttctattggtggtattttctaaatgttggaaggtttatgattattgtgatttttcccttctgctgactgaagttagtagaaatgggcagttctttgctggtggagaagtgattgctgctcacagaatcctcatctggacagaagatggtcacagttacatctatcagctgctgaacagtgggctttcaaaaagcatataccctgctgatggaagagtgcttaaagagaccatttatcctcatttactgtgctctacttctgtgcaggaaaataaggaacagagccgtccctttgttatgggctacatgaatgaaaggaaagagcctttttacaaggtacttttctctggagaagtctcaggaagaattactttgtggcacatccctgatgttcctgtatccaagtttgatggttctcctagagagataccagtaactgccacctggactcttcaagataattttgataagcatgatactatgtcacaaagtattattgactatttctctgggcttaaagatggggcaggaactgctgtagtcacttcatcagagtatattccaagtcttgataaactaatatgtggctgtgaagatgggacaattatcattacccaggctttgaatgctgccaaagcaagacttctggaaggtggttctttagtaaaagattctccccctcataaagttcttaaaggccaccaccaaagtgtcacttcattactctatccacatggtctctcttcgaaattagaccaaagttggatgttgtctggggacctggactcatgtgtgatcttgtgggatatctttactgaagaaattttgcataaattctttttggaagctggtccagtaacaagtcttttgatgtcaccagagaagtttaaactaaggggtgagcagataatttgctgtgtgtgcggtgaccattccgtggctctccttcaccttgagggaaagagttgcctcctgcatgcccggaagcacctttttcctgtgaggatgataaaatggcacccggttgagaattttttaattgttggatgtgcagatgactcagtttatatctgggaaattgaaacaggcactttggaaagacatgagacaggagaaagagcacgaattattcttaattgttgtgatgattcacagcttgtgaagtctgtacttcccattgcctcagagacacttaagcacaaaagtatagaacagagatcctccagcccctaccagcttgggccattaccttgccctggtctgcaggtggagtcttcatgtaaggttactgatgccaaattttgcccaagaccttttaatgtcttgcctgtgaagacaaaatggagtaacgttggctttcatattcttctatttgatctggaaaaccttgttgaacttttgctaccaactccactcagtgatgttgactcttccagttcattctatggtggtgaggtcctgagaagagccaagagcacagtggagaagaagacactgacactgagaaaaagtaaaactgcctgtggtcctctttcagcagaggcactagccaagcctattactgaaagcctggcccaaggagataataccatcaaattctcagaagaaaatgatggcattaaaaggcagaagaaaatgaagatctccaaaaaaatgcagcctaagccatcaagaaaagtagatgccagtctcacaatagacacagcaaaattgtttctgtcttgccttttgccatggggagtggataaagatttagattatctttgcattaagcacctcaatattttaaagcttcagggtcctatttctttgggaatttctttgaatgaagataatttctcactgatgttgccaggttgggatttatgcaatagtggaatgataaaagactattcaggagtaaatttattttccaggaaagttttggacttgtcagataaatacacagccactcttccaaatcaggttggaattccaagaggattggaaaataattgtgattctttgcgagagtcagatactatagtttatttgttgagcagactatttttagttaataaattagttaacatgcctttagaattggcatgtagagttggcagttctttcagaatggaaagtatacataataagatgagaggtgctgggaatgacattttaaatatgtcaagcttctacagttgcttacgaaatggtaagaatgaatcccatgtacctgaggctgacctttcacttttgaagctaatttcctgttggagagaccagtctgtgcaggtaactgaagcaatacaagctgttctcttggcggaagttcaacaacacatgaagagtttgggaaagatacccgtcaatagtcaaccagtgtccatggcagagaatggtaactgtgagatgaagcagatgctgccaaagctggaatggacagaagaactagagttacagtgtgttagaaacactttgcctctgcaaactccagtcagcccggtcaagcatgacagcaactcaaactcggcaaacttccaagacgtggaggacatgcctgacagatgtgccttggaagagtctgagagtccaggtgagccaaggcatcattcatggatagcaaaggtctgcccctgcaaggtgtcttaaatggaatctcatcagtaggagctgaatttggacaaattaagaaatccaaaagatgccatttgtttattactgtataaaagcattgttgttattggtcaagttattaggctgtagtggatttgctaatactttagccaacatgtattaaagtgattttaatacatgctgattacaatgcaatacatactgattgaaaatattcatattcatctaattttagaaaaatattgcctagatcattctctattcctgtttcttactttttctgttaatatttccaacagggaatgccagtccacagacacaaatttaatactgctttaaattttctcctatccttttagtccctgaattatataataaacaatgttaaaaccaatgtagtacacaatacttacttacaaatttaatactgcttcaaggtatttaatctaaaattttaccaactttgatttgtctggttaggatattttgttttagtggatatgctttaattcggatcaattactgcagtaaatctcatccctaagcatgaaatgttgtcaacaaatacccagttccatttagttatcaattagcccaaataagagatacaaagtataacagtgaccaaccttgtactgttgagttaatttgaacttctaatgacattgaggctaatgtctttagctcaaggttgatcttgttggccatatagatgtgaactagggaaggggaatcaacttacagcatatcacaattgatccttattaagtataaactcttgtaggtcttttcccagaaagaagcttgactagcaggaattctaaaactgaaatatatcaaacagcataaataggaatagacataaagtgctcttctattaaagcctttggtgatctatttactatgatttatattgtacagttcctcgatttacagaaaatcatcaaaattattaatctacatatcttatgtatataaatattgcctaatccatagaaaaaaggatataaagtattaaatatgtgatatatagctatatctatctatctatgtatctaatagggaagtccaagtcacttcaattgaagaaacatatctctgagcataggagcagcctcaggtcctatggtgggatgcagtggacaggagagggggaaattagaaaagagaactatataattgaaaaagggatataaagcattaaatatatgatatatagctatatctatgtatgtatctaacagagaagttcaagtcacttcaattaaagaaacatttttgagcatgggaccagcctcaggtcttatgctgggatgcagtagacaggagatggggaaattagaaaagagaactgtgtaattgaaatgacgtgggctgcacccttaaggaacttataattaatgatgatctgaataaacataccaggataaagatgtcaaatgagtgtgactcccttaaagtagattaaagtgtgcattctttgtttcctaaaatatgattttactgcttgaaattacatttgagttgaagtttagaaactaacatagcattaatatgaataatcatggaaaattattatcctttgaaaactgattgataaatatattccccctcctttagaaacagtcaaaagccacttcaaacaagtttcaaaataaaggaaggtagcaagttaggcgatggattatattttcttgcttgttgtataccagttgtcaaggacattataaggactcccaaaagcattttgaaggatggcaatatcaaataagtgtatgtcctctcaaatgaggcatttttaattgttaaaatctatttggacgctcaggttatgatatgtttatgaaaaataagcttcattatttttatagctacatcctattattcccttttagaaacaagaataacaataggttttaatagttgccatacttagcatttatcagttctaatgaaaccaatattgaatctctgataaatattttctgatgttactagctatgggaaattagaactggcacaaccctgacattactaagtggaaatgttaggatttttcggcatcgcatgttagaatctctaaaatttaaacattcctgttaaatgactaaggtttgcttttatcaatatgaattctgaaggccaatatcataccattaactatgaaagcttttaattcctaaaaatagttttagagatattcaagcaatgctctcctaatatccatacgcaagtgtgtttatgacacaaattcactagtctgtttaaaaatgaattctttatattgactggtgttccacatatttcagtaatttctgttatgagaggacttgaaatagcaaattgccacacagttaactggatagaccacgtacgtggtgatcataaccacttggtactacacccagaaactcaaaattgtctttctcctgatgagatatgggtgtccttttgtacgtctaggcctaggtaaccagtggagtgattatattagcaaatgtgtttgtatccggagtcttcctgtcattgtaataaaaaatttatttaaaaa

SEQ ID NO: 34392 - DNA, 7507 bp, Homo sapiens
gttcttttgttcttttctctctgcccccattttgtgggcccccaaattattatgggtcctgggcaccgtccctaatggataagccagccctgatctgagacacagagaggctgagggtctctaagaccactaagctagctacagcagagctcagacaagagcaactaggtctagacctctttctacatttgcgactatgaaaactatggagaaggctctgctcaagaggattcgcccaaaatgaggacttccctgcaggcagtggcactctggggacagaaggcccctccccacagcatcactgccatcatgatcactgatgaccagcgaacgattgtgactggaagtcaagagggtcagctctgtctctggaatctctcacatgaactaaagatttcagcgaaagaactcctatttggtcattcagcttcggtaacatgtttggcaagagcaagggacttctctaaacagccctacattgttagtgctgctgaaaatggggagatgtgtgtttggaatgtcaccaatggacagtgcatggagaaggctacacttccttacaggcacactgcaatctgttattaccactgctcattccggatgacaggagaaggctggcttctttgttgtggagaatatcaagatgtccttataattgatgccaaaactttggctgttgttcacagttttagatcatctcagtttcctgactggatcaactgcatgtgcattgttcactccatgagaattcaagaagattctctcttggtggtatcagtagctggtgagctcaaagtatgggatctttcctcatctatcaacagcattcaggaaaagcaagatgtctatgaaaaagaatccaagtttcttgagtccttgaactgccagacaattcgattttgcacatatactgagagacttctattggtggtattttctaaatgttggaaggtttatgattattgtgatttttcccttctgctgactgaagttagtagaaatgggcagttctttgctggtggagaagtgattgctgctcacagaatcctcatctggacagaagatggtcacagttacatctatcagctgctgaacagtgggctttcaaaaagcatataccctgctgatggaagagtgcttaaagagaccatttatcctcatttactgtgctctacttctgtgcaggaaaataaggaacagagccgtccctttgttatgggctacatgaatgaaaggaaagagcctttttacaaggtacttttctctggagaagtctcaggaagaattactttgtggcacatccctgatgttcctgtatccaagtttgatggttctcctagagagataccagtaactgccacctggactcttcaagataattttgataagcatgatactatgtcacaaagtattattgactatttctctgggcttaaagatggggcaggaactgctgtagtcacttcatcagagtatattccaagtcttgataaactaatatgtggctgtgaagatgggacaattatcattacccaggctttgaatgctgccaaagcaagacttctggaaggtggttctttagtaaaagattctccccctcataaagttcttaaaggccaccaccaaagtgtcacttcattactctatccacatggtctctcttcgaaattagaccaaagttggatgttgtctggggacctggactcatgtgtgatcttgtgggatatctttactgaagaaattttgcataaattctttttggaagctggtccagtaacaagtcttttgatgtcaccagagaagtttaaactaaggggtgagcagataatttgctgtgtgtgcggtgaccattccgtggctctccttcaccttgagggaaagagttgcctcctgcatgcccggaagcacctttttcctgtgaggatgataaaatggcacccggttgagaattttttaattgttggatgtgcagatgactcagtttatatctgggaaattgaaacaggcactttggaaagacatgagacaggagaaagagcacgaattattcttaattgttgtgatgattcacagcttgtgaagtctgtacttcccattgcctcagagacacttaagcacaaaagtatagaacagagatcctccagcccctaccagcttgggccattaccttgccctggtctgcaggtggagtcttcatgtaaggttactgatgccaaattttgcccaagaccttttaatgtcttgcctgtgaagacaaaatggagtaacgttggctttcatattcttctatttgatctggaaaaccttgttgaacttttgctaccaactccactcagtgatgttgactcttccagttcattctatggtggtgaggtcctgagaagagccaagagcacagtggagaagaagacactgacactgagaaaaagtaaaactgcctgtggtcctctttcagcagaggcactagccaagcctattactgaaagcctggcccaaggagataataccatcaaattctcagaagaaaatgatggcattaaaaggcagaagaaaatgaagatctccaaaaaaatgcagcctaagccatcaagaaaagtagatgccagtctcacaatagacacagcaaaattgtttctgtcttgccttttgccatggggagtggataaagatttagattatctttgcattaagcacctcaatattttaaagcttcagggtcctatttctttgggaatttctttgaatgaagataatttctcactgatgttgccaggttgggatttatgcaatagtggaatgataaaagactattcaggagtaaatttattttccaggaaagttttggacttgtcagataaatacacagccactcttccaaatcaggttggaattccaagaggattggaaaataattgtgattctttgcgagagtcagatactatagtttatttgttgagcagactatttttagttaataaattagttaacatgcctttagaattggcatgtagagttggcagttctttcagaatggaaagtatacataataagatgagaggtgctgggaatgacattttaaatatgtcaagcttctacagttgcttacgaaatggtaagaatgaatcccatgtacctgaggctgacctttcacttttgaagctaatttcctgttggagagaccagtctgtgcaggtaactgaagcaatacaagctgttctcttggcggaagttcaacaacacatgaagagtttgggaaagatacccgtcaatagtcaaccagtgtccatggcagagaatggtaactgtgagatgaagcagatgctgccaaagctggaatggacagaagaactagagttacagtgtgttagaaacactttgcctctgcaaactccagtcagcccggtcaagcatgacagcaactcaaactcggcaaacttccaagacgtggaggacatgcctgacagatgtgccttggaagagtctgagagtccaggtgagccaaggcatcattcatggatagcaaaggtctgcccctgcaaggtgtcttaaatggaatctcatcagtaggagctgaatttggacaaattaagaaatccaaaagatgccatttgtttattactgtataaaagcattgttgttattggtcaagttattaggctgtagtggatttgctaatactttagccaacatgtattaaagtgattttaatacatgctgattacaatgcaatacatactgattgaaaatattcatattcatctaattttagaaaaatattgcctagatcattctctattcctgtttcttactttttctgttaatatttccaacagggaatgccagtccacagacacaaatttaatactgctttaaattttctcctatccttttagtccctgaattatataataaacaatgttaaaaccaatgtagtacacaatacttacttacaaatttaatactgcttcaaggtatttaatctaaaattttaccaactttgatttgtctggttaggatattttgttttagtggatatgctttaattcggatcaattactgcagtaaatctcatccctaagcatgaaatgttgtcaacaaatacccagttccatttagttatcaattagcccaaataagagatacaaagtataacagtgaccaaccttgtactgttgagttaatttgaacttctaatgacattgaggctaatgtctttagctcaaggttgatcttgttggccatatagatgtgaactagggaaggggaatcaacttacagcatatcacaattgatccttattaagtataaactcttgtaggtcttttcccagaaagaagcttgactagcaggaattctaaaactgaaatatatcaaacagcataaataggaatagacataaagtgctcttctattaaagcctttggtgatctatttactatgatttatattgtacagttcctcgatttacagaaaatcatcaaaattattaatctacatatcttatgtatataaatattgcctaatccatagaaaaaaggatataaagtattaaatatgtgatatatagctatatctatctatctatgtatctaatagggaagtccaagtcacttcaattgaagaaacatatctctgagcataggagcagcctcaggtcctatggtgggatgcagtggacaggagagggggaaattagaaaagagaactatataattgaaaaagggatataaagcattaaatatatgatatatagctatatctatgtatgtatctaacagagaagttcaagtcacttcaattaaagaaacatttttgagcatgggaccagcctcaggtcttatgctgggatgcagtagacaggagatggggaaattagaaaagagaactgtgtaattgaaatgacgtgggctgcacccttaaggaacttataattaatgatgatctgaataaacataccaggataaagatgtcaaatgagtgtgactcccttaaagtagattaaagtgtgcattctttgtttcctaaaatatgattttactgcttgaaattacatttgagttgaagtttagaaactaacatagcattaatatgaataatcatggaaaattattatcctttgaaaactgattgataaatatattccccctcctttagaaacagtcaaaagccacttcaaacaagtttcaaaataaaggaaggtagcaagttaggcgatggattatattttcttgcttgttgtataccagttgtcaaggacattataaggactcccaaaagcattttgaaggatggcaatatcaaataagtgtatgtcctctcaaatgaggcatttttaattgttaaaatctatttggacgctcaggttatgatatgtttatgaaaaataagcttcattatttttatagctacatcctattattcccttttagaaacaagaataacaataggttttaatagttgccatacttagcatttatcagttctaatgaaaccaatattgaatctctgataaatattttctgatgttactagctatgggaaattagaactggcacaaccctgacattactaagtggaaatgttaggatttttcggcatcgcatgttagaatctctaaaatttaaacattcctgttaaatgactaaggtttgcttttatcaatatgaattctgaaggccaatatcataccattaactatgaaagcttttaattcctaaaaatagttttagagatattcaagcaatgctctcctaatatccatacgcaagtgtgtttatgacacaaattcactagtctgtttaaaaatgaattctttatattgactggtgttccacatatttcagtaatttctgttatgagaggacttgaaatagcaaattgccacacagttaactggatagaccacgtacgtggtgatcataaccacttggtactacacccagaaactcaaaattgtctttctcctgatgagatatgggtgtccttttgtacgtctaggcctaggtaaccagtggagtgattatattagcaaatgtgtttgtatccggagtcttcctgtcattgtaataaaaaatttatttaaaaattttgtcttgtgtttcttttttggtaatcatcttggtgatatttatgaatgtatttgtgtgtgtgtgtgtgtgtgtatacatacatatatatgtgtgtatatatatacacacatatatatacacatatatatgtgtgtatatatatatatatatggcatatcccccaaaggaatatcatattttcatttgcaagccttgattctttgacttgctgttgagtttcacattggctccattgtatattgcaggaaaaagtacctggaaagcctggagggttaaaagcagaggctcctcggcagcgtgtccaggccgtgtgtgcttgctgtgcttgtcagagcctcattccctcccctgtgttggagagctttctcacagggctcatccagaggtgctagaaagcaatgtgagcactattaaacacttcaaatataaggaaaaatgtataatgttagaaacacacagttaaaaagtagccccaggtatcaaacattctgttactattttagaaactaaattaaggctgctttgaacatgatggtattagaaaaatggtagaatacagtttgttaaatattaatattctatctttagatgatagcatttggtgacttttatttcttttctcatacattttttccagtgttctgtatttttaaaatcctttcataattattataatgaacactttagaaaagatactatttctcttccatccttagagggcacattataataattgagtattttaaaattaaattttatgccatgtatttaaaatgaaagttcaggttacattaattccaactgattttaaagccttattttcacagagtggactcattcaattttttaaattttatattcatacattttgattgctcagttatataaaagcggtgttatagactcctttattctccacaaaatgttgtcttatatgtaaagtgccaaaagttgtgtttaatttcctaagaaagtcattgctttgtaaacatttgcataatacttagtgttttttgtaattttaaaaaattagcttaaccaaaagagttgcaaaattaaaacttacttgagtaggtatctttcagacaaagctgcatggcttcatgtacaatagtccccagatcacctcgcactgtagtttgctcaagaaggagcctacagatggcaggtaggagaaggtaaactggaaattaacaggtctgtctgtaagagcatgccactggaaacacccatccaatttgggacccctggaagacagcatgtgtctaatgggaggcctgtcctagtacaactcctttactcttttcaccttcatcttgaccttctcagataccatctttatgtaaaatgttgatgttgtggagtttttgcagtaatttaatttttataaatattgtattaaaatatatttatcttga

SEQ ID NO: 34393 - DNA, 5900 bp, Homo sapiens
aggtaaggcaggcacccccagagcgcaggtcgggctgccgggtcccaggattcgcccaaaatgaggacttccctgcaggcagtggcactctggggacagaaggcccctccccacagcatcactgccatcatgatcactgatgaccagcgaacgattgtgactggaagtcaagagggtcagctctgtctctggaatctctcacatgaactaaagatttcagcgaaagaactcctatttggtcattcagcttcggtaacatgtttggcaagagcaagggacttctctaaacagccctacattgttagtgctgctgaaaatggggagatgtgtgtttggaatgtcaccaatggacagtgcatggagaaggctacacttccttacaggcacactgcaatctgttattaccactgctcattccggatgacaggagaaggctggcttctttgttgtggagaatatcaagatgtccttataattgatgccaaaactttggctgttgttcacagttttagatcatctcagtttcctgactggatcaactgcatgtgcattgttcactccatgagaattcaagattctctcttggtggtatcagtagctggtgagctcaaagtatgggatctttcctcatctatcaacagcattcaggaaaagcaagatgtctatgaaaaagaatccaagtttcttgagtccttgaactgccagacaattcgattttgcacatatactgagagacttctattggtggtattttctaaatgttggaaggtttatgattattgtgatttttcccttctgctgactgaagttagtagaaatgggcagttctttgctggtggagaagtgattgctgctcacagaatcctcatctggacagaagatggtcacagttacatctatcagctgctgaacagtgggctttcaaaaagcatataccctgctgatggaagagtgcttaaagagaccatttatcctcatttactgtgctctacttctgtgcaggaaaataagagccgtccctttgttatgggctacatgaatgaaaggaaagagcctttttacaaggtacttttctctggagaagtctcaggaagaattactttgtggcacatccctgatgttcctgtatccaagtttgatggttctcctagagagataccagtaactgccacctggactcttcaagataattttgataagcatgatactatgtcacaaagtattattgactatttctctgggcttaaagatggggcaggaactgctgtagtcacttcatcagagtatattccaagtcttgataaactaatatgtggctgtgaagatgggacaattatcattacccaggctttgaatgctgccaaagcaagacttctggaaggtggttctttagtaaaagattctccccctcataaagttcttaaaggccaccaccaaagtgtcacttcattactctatccacatggtctctcttcgaaattagaccaaagttggatgttgtctggggacctggactcatgtgtgatcttgtgggatatctttactgaagaaattttgcataaattctttttggaagctggtccagtaacaagtcttttgatgtcaccagagaagtttaaactaaggggtgagcagataatttgctgtgtgtgcggtgaccattccgtggctctccttcaccttgagggaaagagttgcctcctgcatgcccggaagcacctttttcctgtgaggatgataaaatggcacccggttgagaattttttaattgttggatgtgcagatgactcagtttatatctgggaaattgaaacaggcactttggaaagacatgagacaggagaaagagcacgaattattcttaattgttgtgatgattcacagcttgtgaagtctgtacttcccattgcctcagagacacttaagcacaaaagtatagaacagagatcctccagcccctaccagcttgggccattaccttgccctggtctgcaggtggagtcttcatgtaaggttactgatgccaaattttgcccaagaccttttaatgtcttgcctgtgaagacaaaatggagtaacgttggctttcatattcttctatttgatctggaaaaccttgttgaacttttgctaccaactccactcagtgatgttgactcttccagttcattctatggtggtgaggtcctgagaagagccaagagcacagtggagaagaagacactgacactgagaaaaagtaaaactgcctgtggtcctctttcagcagaggcactagccaagcctattactgaaagcctggcccaaggagataataccatcaaattctcagaagaaaatgatggcattaaaaggcagaagaaaatgaagatctccaaaaaaatgcagcctaagccatcaagaaaagtagatgccagtctcacaatagacacagcaaaattgtttctgtcttgccttttgccatggggagtggataaagatttagattatctttgcattaagcacctcaatattttaaagcttcagggtcctatttctttgggaatttctttgaatgaagataatttctcactgatgttgccaggttgggatttatgcaatagtggaatgataaaagactattcaggagtaaatttattttccaggaaagttttggacttgtcagataaatacacagccactcttccaaatcaggttggaattccaagaggattggaaaataattgtgattctttgcgagagtcagatactatagtttatttgttgagcagactatttttagttaataaattagttaacatgcctttagaattggcatgtagagttggcagttctttcagaatggaaagtatacataataagatgagaggtgctgggaatgacattttaaatatgtcaagcttctacagttgcttacgaaatggtaagaatgaatcccatgtacctgaggctgacctttcacttttgaagctaatttcctgttggagagaccagtctgtgcaggtaactgaagcaatacaagctgttctcttggcggaagttcaacaacacatgaagagtttgggaaagatacccgtcaatagtcaaccagtgtccatggcagagaatggtaactgtgagatgaagcagatgctgccaaagctggaatggacagaagaactagagttacagtgtgttagaaacactttgcctctgcaaactccagtcagcccggtcaagcatgacagcaactcaaactcggcaaacttccaagacgtggaggacatgcctgacagatgtgccttggaagagtctgagagtccaggtgagccaaggcatcattcatggatagcaaaggtctgcccctgcaaggtgtcttaaatggaatctcatcagtaggagctgaatttggacaaattaagaaatccaaaagatgccatttgtttattactgtataaaagcattgttgttattggtcaagttattaggctgtagtggatttgctaatactttagccaacatgtattaaagtgattttaatacatgctgattacaatgcaatacatactgattgaaaatattcatattcatctaattttagaaaaatattgcctagatcattctctattcctgtttcttactttttctgttaatatttccaacagggaatgccagtccacagacacaaatttaatactgctttaaattttctcctatccttttagtccctgaattatataataaacaatgttaaaaccaatgtagtacacaatacttacttacaaatttaatactgcttcaaggtatttaatctaaaattttaccaactttgatttgtctggttaggatattttgttttagtggatatgctttaattcggatcaattactgcagtaaatctcatccctaagcatgaaatgttgtcaacaaatacccagttccatttagttatcaattagcccaaataagagatacaaagtataacagtgaccaaccttgtactgttgagttaatttgaacttctaatgacattgaggctaatgtctttagctcaaggttgatcttgttggccatatagatgtgaactagggaaggggaatcaacttacagcatatcacaattgatccttattaagtataaactcttgtaggtcttttcccagaaagaagcttgactagcaggaattctaaaactgaaatatatcaaacagcataaataggaatagacataaagtgctcttctattaaagcctttggtgatctatttactatgatttatattgtacagttcctcgatttacagaaaatcatcaaaattattaatctacatatcttatgtatataaatattgcctaatccatagaaaaaaggatataaagtattaaatatgtgatatatagctatatctatctatctatgtatctaatagggaagtccaagtcacttcaattgaagaaacatatctctgagcataggagcagcctcaggtcctatggtgggatgcagtggacaggagagggggaaattagaaaagagaactatataattgaaaaagggatataaagcattaaatatatgatatatagctatatctatgtatgtatctaacagagaagttcaagtcacttcaattaaagaaacatttttgagcatgggaccagcctcaggtcttatgctgggatgcagtagacaggagatggggaaattagaaaagagaactgtgtaattgaaatgacgtgggctgcacccttaaggaacttataattaatgatgatctgaataaacataccaggataaagatgtcaaatgagtgtgactcccttaaagtagattaaagtgtgcattctttgtttcctaaaatatgattttactgcttgaaattacatttgagttgaagtttagaaactaacatagcattaatatgaataatcatggaaaattattatcctttgaaaactgattgataaatatattccccctcctttagaaacagtcaaaagccacttcaaacaagtttcaaaataaaggaaggtagcaagttaggcgatggattatattttcttgcttgttgtataccagttgtcaaggacattataaggactcccaaaagcattttgaaggatggcaatatcaaataagtgtatgtcctctcaaatgaggcatttttaattgttaaaatctatttggacgctcaggttatgatatgtttatgaaaaataagcttcattatttttatagctacatcctattattcccttttagaaacaagaataacaataggttttaatagttgccatacttagcatttatcagttctaatgaaaccaatattgaatctctgataaatattttctgatgttactagctatgggaaattagaactggcacaaccctgacattactaagtggaaatgttaggatttttcggcatcgcatgttagaatctctaaaatttaaacattcctgttaaatgactaaggtttgcttttatcaatatgaattctgaaggccaatatcataccattaactatgaaagcttttaattcctaaaaatagttttagagatattcaagcaatgctctcctaatatccatacgcaagtgtgtttatgacacaaattcactagtctgtttaaaaatgaattctttatattgactggtgttccacatatttcagtaatttctgttatgagaggacttgaaatagcaaattgccacacagttaactggatagaccacgtacgtggtgatcataaccacttggtactacacccagaaactcaaaattgtctttctcctgatgagatatgggtgtccttttgtacgtctaggcctaggtaaccagtggagtgattatattagcaaatgtgtttgtatccggagtcttcctgtcattgtaataaaaaatttatttaaaaatttt

SEQ ID NO: 34394 - DNA, 2572 bp, Homo sapiens
cagatgtggcatcaggagtgaacaaagccgctcatctcgcagtatccctacctatgctcctgggaggagtctaccccagatacgctctgaccttcggcaagttacttatgttctccaagactcattttcttcatgtttggaatagtgataataatgcatattgatattatgaggaccgcatgaagcagtgaacgtaatctaagcagcacagtgtctacaacttaacatatagtcagattcgcccaaaatgaggacttccctgcaggcagtggcactctggggacagaaggcccctccccacagcatcactgccatcatgatcactgatgaccagcgaacgattgtgactggaagtcaagagggtcagctctgtctctggaatctctcacatgaactaaagatttcagcgaaagaactcctatttggtcattcagcttcggtaacatgtttggcaagagcaagggacttctctaaacagccctacattgttagtgctgctgaaaatggggagatgtgtgtttggaatgtcaccaatggacagtgcatggagaaggctacacttccttacaggcacactgcaatctgttattaccactgctcattccggatgacaggagaaggctggcttctttgttgtggagaatatcaagatgtccttataattgatgccaaaactttggctgttgttcacagttttagatcatctcagtttcctgactggatcaactgcatgtgcattgttcactccatgagaattcaagaagattctctcttggtggtatcagtagctggtgagctcaaagtatgggatctttcctcatctatcaacagcattcaggaaaagcaagatgtctatgaaaaagaatccaagtttcttgagtccttgaactgccagacaattcgattttgcacatatactgagagacttctattggtggtattttctaaatgttggaaggtttatgattattgtgatttttcccttctgctgactgaagttagtagaaatgggcagttctttgctggtggagaagtgattgctgctcacagaatcctcatctggacagaagatggtcacagttacatctatcagctgctgaacagtgggctttcaaaaagcatataccctgctgatggaagagtgcttaaagagaccatttatcctcatttactgtgctctacttctgtgcaggaaaataaggaacagagccgtccctttgttatgggctacatgaatgaaaggaaagagcctttttacaaggtacttttctctggagaagtctcaggaagaattactttgtggcacatccctgatgttcctgtatccaagtttgatggttctcctagagagataccagtaactgccacctggactcttcaagataattttgataagcatgatactatgtcacaaagtattattgactatttctctgggcttaaagatggggcaggaactgctgtagtcacttcatcagagtatattccaagtcttgataaactaatatgtggctgtgaagatgggacaattatcattacccaggctttgaatgctgccaaagcaagacttctggaaggtggttctttagtaaaagattctccccctcataaagttcttaaaggccaccaccaaagtgtcacttcattactctatccacatggtctctcttcgaaattagaccaaagttggatgttgtctggggacctggactcatgtgtgatcttgtgggatatctttactgaagaaattttgcataaattctttttggaagctggtccagtaacaagtcttttgatgtcaccagagaagtttaaactaaggggtgagcagataatttgctgtgtgtgcggtgaccattccgtggctctccttcaccttgagggaaagagttgcctcctgcatgcccggaagcacctttttcctgtgaggatgataaaatggcacccggttgagaattttttaattgttggatgtgcagatgactcagtttatatctgggaaattgaaacaggcactttggaaagacatgagacaggagaaagagcacgaattattcttaattgttgtgatgattcacagcttgtgaagtctgtacttcccattgcctcagagacacttaagcacaaaagtatagaacagagatcctccagcccctaccagcttgggccattaccttgccctggtctgcaggtggagtcttcatgtaaggttactgatgccaaattttgcccaagaccttttaatgtcttgcctgtgaagacaaaatggagtaacgttggctttcatattcttctatttgatctggaaaaccttgttgaacttttgctaccaactccactcagtgatgttgactcttccagttcattctatggtggtgaggtcctgagaagagccaagagcacagtggagaagaagacactgacactgagaaaaagtaaaactgcctgtggtcctctttcagcagaggcactagccaagcctattactgaaagcctggcccaaggagataataccatcaaattctcagaagaaaatgatggcattaaaaggcagaagaaaatgaagatctcc

SEQ ID NO: 34395 - DNA, 2576 bp, Homo sapiens
agtcaagtaacgctgagagcctatcgcatgagggcgacagccggaaagcaggatggagccatagaagcaattctcgcgagaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgaagcatgtgtgttatgtgtagttagatatatttcacttatgtgagtcatcatggtgttggtcttgtagcccattatttttcctgtgcttccccagcttcccaaagtagctagttagaacttaaggtaaatatttattcttgggttggtggagtggatattgccagttaggagtcatggatcaattactgattatattgaaagtaaatataatcaattatgtacttttgagctttgcaggttcaatttaggtaaaaatcacattatgaaactgggaaagtctgaaggaatatgggcaaaatatttctcagtaaagcttccatgcttcacccttgacatgattacccttgagtaaaacatgggaatttgta

SEQ ID NO: 34396 - DNA, 976 bp, Homo sapiens
gtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgcc

SEQ ID NO: 34397 - DNA, 877 bp, Homo sapiens
cctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacaggctggacctttcacaaccctctcctccatctgatagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagat

SEQ ID NO: 34398 - DNA, 4293 bp, Homo sapiens
ttctgcctgtcgccccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgagcaccatgttctttgaaaacatgccacctcaaggctgggcgcggtggctcacacctgtaatcccagcactttgggaggccgaggcgggcggatcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtctcaaaaaaaaaaaaaaaaaaatgccacctcacagtctctatcgttgggccctgtggttgcaaagctgcctcctgaattaagaaggaaagggaaaagatatagctggaagcgagtggaagagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtcttaaacagaattttatggctgca

SEQ ID NO: 34399 - DNA, 1847 bp, Homo sapiens
ccccggaaggagtcgcgagagaggcggcccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatggaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttg

SEQ ID NO: 34400 - DNA, 2626 bp, Homo sapiens
ggggcagaatacggaaagcgggagggacaaattgccaatgtttggagtctggtttccaggttgccgtttttgggggctctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtatgaataccctattcagcggtcaaagaaagattctgagggaatagaaatgggagtcgcaggttctgtaagccttctgcagaatgttacgttgtccacccagcccatttcaagtttggattggagtccagataaaaggggtctctgcgtctgtagttcatttgaccaaacggtgagagtactgatcgttacaaagctcaataaaatttgacttcaagactttggacttgaggctgggcacggtggctcactcctgtaatcccagcactttgggaggccgaggcgggtggatcagaaggtcaggagatcgagaccatcctggctaacatggtgaaaccccgtctctactaaaaatataaaaaaaaatttgctgggtgtcatggcgggcatctgtagtcctagctacttgggaggctgaggcaggagaatggcgtgaacccgggaggcggaggttgcagtgagccgagattgtgccactgcactccagcctgggcaactgagcaagactgtctcaaaaaaaaaaaaaaaaaaaaagactttggacttgaaaccttccagaggaacactcacacaatttaagataggttctggagtcctctgaccctcattgaacaaagctggatttggctgatgataaaagaccccagccacaagcctctgggccagcctccagcctctctcggggcttgtttgctgacttgctgctgcacgtgggtatcagaagcaccaagtaaactatctccagggccagttcttttctctcccttccatttctaagtcaatagttgtctataattaaacatatttcagatttgttctgtgtccctgaagttccatattttatctttatgcttgtgttatgttttagtgtctataatgttgtggtgggaatcatttcatttggtttaaaagagtttgccttggaaaaactgaattaaccttcataaatacattttgagagatttcagtgtgagtaattttctggacataatattattgtataaaatatcaaaatggtgggccaggcgtggtagctcacgcctgtaattccagcactttgggaggctgaggcgggtgaatcacgaggtcaggaattcgagaccagcctggccaacatggtcaaaacccgtctctactaaaaatacaaaaaattagctgggcttagtggcgggcgcctgtaatcacagctacttgggaggctgaggcaggagaatcacttgaacccaggaggtggagattgcagtgagctgagattgcgccactgcactccagccctggcgacagagtgagactccgtctcaaaaaaaaaaaaaacaaatatatatatatatatctctctctctcaaaacggcacggttggtctagatttgggtagctattttctgcaatttaattcataaaacaaaatgctttgattttaaagagctcttttttacttaaaatacaggaactgaattggtgagacttttggtttttgactgtggtaagtgatggtgaaatgtacaagattgtaggggttttgtagtcttatttttggtcatactttaaaaatgcattttatgaataaacttctgtttttgagatctacagaagctttgattctgttaccttaacagtagtaataaagttaacattgtcacatcatt

SEQ ID NO: 34401 - DNA, 1517 bp, Homo sapiens
ctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtagtaagtctgccagtgcacactgctccttttaaagttacctgtgggtgtaaagtaggattagattgaacttttttttcttttttttcctgctttgacttagttcattttgatatgatttaaaatttcatggtgttacataacttgttttctaagcattttgtatgaatatactttacacttagtagagtgtacactaatcttcttttgatacattttagtatatcattttagttgtgtcttctaagtatgaaaaagttggcccaagacttttatcagatactatcttgaagtgattagaacactcactgcctctaaaagatggggaaagggttccttgcctaaatttagataacatcattgtgatagaccccaacagagcctgaggctgctgattggtctccaggaaagatcttatcactgaatttgctttctgcatatctaggcagggtgagttacaatgaaagcttttactatgcacaccactttctgaatcccaagggcgctaacatcacagatactagatcatttaaaaggtctgatatcattgctcagggttggcctgtgaaaaggaaacaaaacaaaacaaaacaaaaattaaaggtctgataaaaa

SEQ ID NO: 34402 - DNA, 4196 bp, Homo sapiens
agcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtggtcattgagactgcctcttctcaaagggacactgtcctcagcactttatacagcagtttaaataaagtcattctttattgcctatccaagccccagcagtccctctccgaatgcctcggccttctcagcatcctgggctttctgcaggagcactgggatgttgtctttgccacctacaattccaacatcagcttcctcctgtgtctcatgcattgccttttgctactcaatgagagaagttacccagaaggatttggattggagcccaagcctagaatgtctacttatcatcaagtcttcctttccccaaatgaagacgtgaaagaaaaaagagaagacttaccaagtttgagtgatgtccaacacaacatccagaagacagtgcagactctctggcagcagctggtggcacaaaggcagcagaccctggaggatgccttcaagatcgatctctctgtgaaacctggagagagggaagtgaagattgaagaggtcacaccgctctgggaggagacgatgctcaaggcctggcagcattacttagcatctgagaagaagtcactggcaagtcgttcaaatgttgcacaccacagcaaagtcactttgtggagtggaagcctgtcctcagccatgaagctgatgcccgggcggcaggccaaggaccctgagtgcaagacagaggattttgtgtcatgtatagagaactacagaagaagaggacaagagctatatgcatctttatacaaagaccatgtgcaaaggcgaaaatgtggcaacatcaaggcagccaacgcctgggccaggatccaggagcagctttttggggagctgggcttgtggagccagggggaagaaaccaagccctgttccccatgggaactcgactggagagaaggaccagctcgaatgaggaaacgcatcaaacgcttgtctcctttggaggccctgagctcaggaaggcacaaggaaagccaagacaaaaatgatcatatttctcaaacaaatgctgaaaaccaagatgaactgacactgagggaggctgagggcgagccggacgaggtgggggtggactgcacccagctgaccttcttcccagccttacacgaaagtctgcactcagaagacttcttggaactgtgtcgggaaagacaagttattttacaagagcttcttgataaagaaaaggtgacgcagaagttctccctggtgattgtgcagggccacctggtgtcagaaggggtcctgctttttggccaccaacacttctacatctgcgagaacttcacactgtctcccacgggtgatgtctactgtacccgtcactgcttatccaacatcagcgatccgttcattttcaacctgtgcagcaaagacaggtccactgaccattactcgtgccagtgccacagctacgctgacatgcgggagctacggcaggctcgcttcctcctgcaggacatcgccctggagatcttcttccacaatggatattccaagtttcttgtcttctacaacaatgatcggagtaaggcctttaaaagcttctgctctttccaacccagcctgaaggggaaagccacctcggaggacaccctcagtctaaggagataccccggctctgacaggatcatgctgcagaagtggcagaaaagggacatcagcaattttgagtatctcatgtacctcaacaccgcggctgggagaacctgcaatgactacatgcagtacccagtgttcccctgggtcctcgcagactacacctcagagacattgaacttggcaaatccgaagattttccgggatctttcaaagcccatgggggctcagaccaaggaaaggaagctgaaatttatccagaggtttaaagaagttgagaaaactgaaggagacatgactgtccagtgccactactacacccactactcctcggccatcatcgtggcctcctacctggtccggatgccacccttcacccaggccttctgcgctctgcagggcggaagcttcgacgtggcagacagaatgttccacagtgtgaagagcacgtgggagtcggcctccagagagaacatgagtgacgtcagggagctgaccccagagttcttctacctgcctgagttcttaaccaactgcaacggggtagagttcggctgcatgcaggacgggactgtgctaggagacgtgcagctccctccctgggctgatggggaccctcggaaattcatcagcctgcacagaaaggccctggaaagtgactttgtcagtgccaacctccaccattggatagaccttatttttgggtacaagcagcaggggccagccgcagtggatgctgttaatatcttccacccctacttctacggtgacagaatggacctcagcagcatcactgaccccctcatcaaaagcaccatcctggggtttgtcagcaactttggacaggtgcccaaacagctctttaccaaacctcacccagccaggactgcagcagggaagcctctgcctggaaaggatgtctccacccccgtgagcctgcctggccacccacagccctttttctacagcctgcagtcgctgaggccctcccaggtcacggtcaaagatatgtacctcttttctctaggctcagagtcccccaaaggggccattggccacattgtctctactgagaagaccattctggctgtagagaggaacaaagtgctgctgcctcctctctggaacaggaccttcagctggggctttgatgacttcagctgctgcttggggagctacggctccgacaaggtcctgatgacattcgagaacctggctgcctggggccgctgtctgtgcgccgtgtgcccatccccaacaacgattgtcacctctgggaccagcactgtggtgtgtgtgtgggagctcagcatgaccaaaggccgcccgaggggcttgcgcctccggcaggccttgtatggacacacacaggctgtcacgtgcctggcagcgtcagtcaccttcagcctcctggtgagcggctcccaggactgcacctgtatcctgtgggatctggaccacctcacccacgtgacccgcctgcccgcccatcgggaaggcatctcagccatcaccatcagtgacgtctcaggcaccattgtctcctgtgcgggagcacacttgtccctgtggaatgtcaatggacagcccctggccagcatcaccacagcctggggcccagaaggagccataacctgctgctgcctgatggagggcccagcatgggacacaagccagatcatcatcaccgggagtcaagacggcatggtccgggtttggaagactgaggatgtgaagatgtctgttcctggacggccagcaggagaggagcccccggctcagcctccaagcccaagaggccacaagtgggagaagaacctggccttgagtcgagagctggacgttagcattgctttgacagggaagcccagcaaaaccagccccgcagtgactgctctggccgtgtccagaaaccacaccaaactcctggttggtgatgagagggggagaatattctgctggtctgcagatgggtaggaagagagaggcagcagaggctctggcacaacagtgccaggctgagggtggcagaggtgactggggcctgagctctgcctacagaagaaacccccagggcctccttccccacagttctcaaggaagggcctctggcaatcacagctctgcagcccaaccctctccatggccgatgggacttctatgaaaaggatgagcacacacactcggagggctgagcagcacgctggaaactgtgacttggtgatgcccagctgcacacgaaattacacatgactcaccttattaagggctattgcactgaaaaaaaaaaagatgggtcgcttactggaaattattgtattgtctttattttattaaagcaactatgttttaaatgca

SEQ ID NO: 34403 - DNA, 6996 bp, Homo sapiens
gaagctcgcttcccaggccattgaaccggatgtgctaagacagtttctaggtcttggaattccctcatctctgtcggccacaacaaaaatccttgattcatctcacacacacagaggcaaccctgggtgctcagggtcacagactgcacagggcttggctgaggggccctggccagctgccccagatgctgggctgcaccctggagtcacacaggccccgcagcccttgggggaatcccaggattcaactactgctcttcagacggcgctgagcctcatctccatgacctccccacgcaacctgcagcctcagagggcagccctggccccatcgtttgtggaatttgacatgtccgtggaaggttatggctgtttgtttattccaaccctgtccacagttatgggaaccagcactgagtactctgtctctggaggaattgggacaggtgccaccagaccgttccctcctcctggaggtctgaccttctcctgctggttcctgatcagccggcatggagctgccactgagggccacccgctgcgcttcctgacgttggtgcgccacctggccaggactgagcaaccctttgtttgcttctccgtcagcctctgcccagacgacctctccttggttgtttctacagaagagaaggagtttcagcctctggatgtcatggaacctgaggatgactccgagccttctgcaggatgccagcttcaggtcaggtgtggccagctcctggcttgtggtcagtggcatcacttggctgtggttgtcactaaggaaatgaaaaggcattgtacagtttccacctgtctggatggacaggtcattggctctgccaagatgttatacatccaggctctaccagggcctttcctttctatggatccatccgcatttgtggatgtttatggatatattgctactcctcgagtctggaaacaaaagtcttcattaatctggcgtcttggccccacatacctctttgaagaagccatttcaatggaaactctggaagttattaacaaacttggcccaagatattgtggtaacttccaagctgtgcatgtccaaggggaggacctggacagtgaagccacgccctttgttgcagaagaaagagtttcttttggacttcacatagccagctcctctatcaccagtgtagcggacatcagaaatgcttacaatgaggtggacagccgcctgatcgccaaagagatgaacatttcatcccgtgacaatgccatgcccgtgttcttgctgaggaattgtgctggccacctgtcagggtctctgcggaccattggagctgttgctgtgggtcaattaggggtgagggtattccactccagccctgctgccagcagcctggacttcattggcgggcctgccatcctcctgggcctcatctccttagcgacagatgaccataccatgtatgcggctgtgaaagttctgcactcggtcctgaccagtaatgccatgtgtgacttcctgatgcaacacatctgtgggtaccagataatggcgtttctcctgaggaagaaggcctctctcctgaaccatcgaatttttcagctgatcctctcagtggctggcactgtggagctgggcttcaggtcatctgctatcaccaacactggtgtcttccagcacatcctctgcaatttcgagctctggatgaatactgcagacaatctggagctcagcctcttttcccatcttttggaaatccttcaatcaccaagggaaggacccaggaatgctgaagctgcccaccaggcacagcttatacccaagctcatcttcctattcaatgagccgagcctcatcccctccaagatctccaccatcattggcatcctggcctgtcagctgaggggccacttcagcacccaggacttgctcaggattgggctgtttgttgtgtacaccctcaagccttcgtcggtgaatgagaggcagatctgcatggacggagccctggacccttccctgcctgctggaagccaaacatctggaaagacaatctggctcagaaaccagttgctggagatgctgctcagtgtaatatcttccccccagcttcatctgtcctctgagtcaaaggaagagatgtttctgaaactggggcctgactggttcctgctgctcctgcagggccacctgcatgccagcaccactgtgctggcattgaagctgctgctgtactttctggcaagcccctccctccgcacacggtttagagatggcctgtgtgcaggatcctgggtggaacgcagcactgagggcgtggatattgtaatggacaacctgaagagccagtcaccactgcctgagcaaagcccatgcctgcttcctgggttccgtgtcttgaatgactttctggcccaccacgtccacattccagaggtctacctcatcgtctccaccttcttcctgcagacaccactcacagagctgatggacgggcccaaagacagccttgatgccatgcttcagtggctcctgcagaggcaccaccaggaagaagtcctccaggctgggctgtgcacagaaggtgccttgctcctcctggaaatgctgaaggccaccatgagccagcccctggcaggttctgaggatggtgcctgggcacagaccttcccggccagcgtgctgcagttcctcagcctcgtccaccgcacctacccccaggacccagcgtggcgagccccggagttcctccagaccttggccatagccgccttccccctgggagcccaaaagggggttggggctgagtccacccggaacaccagcagtcctgaggccgcagctgaaggcgacagcacagtggagggtctccaggctcccaccaaggcacatcccgcccggaggaagctgagggagttcacgcagctcctcttgagggagctcctgcttggagcctccagccccaagcagtggctgcccctggaggtgctcctggaggcttctccagaccacgccaccagccaacagaagcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtggtcattgagactgcctcttctcaaagggacactgtcctcagcactttatacagcagtttaaataaagtcattctttattgcctatccaagccccagcagtccctctccgaatgcctcggccttctcagcatcctgggctttctgcaggagcactgggatgttgtctttgccacctacaattccaacatcagcttcctcctgtgtctcatgcattgccttttgctactcaatgagagaagttacccagaaggatttggattggagcccaagcctagaatgtctacttatcatcaagtcttcctttccccaaatgaagacgtgaaagaaaaaagagaagacttaccaagtttgagtgatgtccaacacaacatccagaagacagtgcagactctctggcagcagctggtggcacaaaggcagcagaccctggaggatgccttcaagatcgatctctctgtgaaacctggagagagggaagtgaagattgaagaggtcacaccgctctgggaggagacgatgctcaaggcctggcagcattacttagcatctgagaagaagtcactggcaagtcgttcaaatgttgcacaccacagcaaagtcactttgtggagtggaagcctgtcctcagccatgaagctgatgcccgggcggcaggccaaggaccctgagtgcaagacagaggattttgtgtcatgtatagagaactacagaagaagaggacaagagctatatgcatctttatacaaagaccatgtgcaaaggcgaaaatgtggcaacatcaaggcagccaacgcctgggccaggatccaggagcagctttttggggagctgggcttgtggagccagggggaagaaaccaagccctgttccccatgggaactcgactggagagaaggaccagctcgaatgaggaaacgcatcaaacgcttgtctcctttggaggccctgagctcaggaaggcacaaggaaagccaagacaaaaatgatcatatttctcaaacaaatgctgaaaaccaagatgaactgacactgagggaggctgagggcgagccggacgaggtgggggtggactgcacccagctgaccttcttcccagccttacacgaaagtctgcactcagaagacttcttggaactgtgtcgggaaagacaagttattttacaagagcttcttgataaagaaaaggtgacgcagaagttctccctggtgattgtgcagggccacctggtgtcagaaggggtcctgctttttggccaccaacacttctacatctgcgagaacttcacactgtctcccacgggtgatgtctactgtacccgtcactgcttatccaacatcagcgatccgttcattttcaacctgtgcagcaaagacaggtccactgaccattactcgtgccagtgccacagctacgctgacatgcgggagctacggcaggctcgcttcctcctgcaggacatcgccctggagatcttcttccacaatggatattccaagtttcttgtcttctacaacaatgatcggagtaaggcctttaaaagcttctgctctttccaacccagcctgaaggggaaagccacctcggaggacaccctcagtctaaggagataccccggctctgacaggatcatgctgcagaagtggcagaaaagggacatcagcaattttgagtatctcatgtacctcaacaccgcggctgggagaacctgcaatgactacatgcagtacccagtgttcccctgggtcctcgcagactacacctcagagacattgaacttggcaaatccgaagattttccgggatctttcaaagcccatgggggctcagaccaaggaaaggaagctgaaatttatccagaggtttaaagaagttgagaaaactgaaggagacatgactgtccagtgccactactacacccactactcctcggccatcatcgtggcctcctacctggtccggatgccacccttcacccaggccttctgcgctctgcagggcggaagcttcgacgtggcagacagaatgttccacagtgtgaagagcacgtgggagtcggcctccagagagaacatgagtgacgtcagggagctgaccccagagttcttctacctgcctgagttcttaaccaactgcaacggggtagagttcggctgcatgcaggacgggactgtgctaggagacgtgcagctccctccctgggctgatggggaccctcggaaattcatcagcctgcacagaaaggccctggaaagtgactttgtcagtgccaacctccaccattggatagaccttatttttgggtacaagcagcaggggccagccgcagtggatgctgttaatatcttccacccctacttctacggtgacagaatggacctcagcagcatcactgaccccctcatcaaaagcaccatcctggggtttgtcagcaactttggacaggtgcccaaacagctctttaccaaacctcacccagccaggactgcagcagggaagcctctgcctggaaaggatgtctccacccccgtgagcctgcctggccacccacagccctttttctacagcctgcagtcgctgaggccctcccaggtcacggtcaaagatatgtacctcttttctctaggctcagagtcccccaaaggggccattggccacattgtctctactgagaagaccattctggctgtagagaggaacaaagtgctgctgcctcctctctggaacaggaccttcagctggggctttgatgacttcagctgctgcttggggagctacggctccgacaaggtcctgatgacattcgagaacctggctgcctggggccgctgtctgtgcgccgtgtgcccatccccaacaacgattgtcacctctgggaccagcactgtggtgtgtgtgtgggagctcagcatgaccaaaggccgcccgaggggcttgcgcctccggcaggccttgtatggacacacacaggctgtcacgtgcctggcagcgtcagtcaccttcagcctcctggtgagcggctcccaggactgcacctgtatcctgtgggatctggaccacctcacccacgtgacccgcctgcccgcccatcgggaaggcatctcagccatcaccatcagtgacgtctcaggcaccattgtctcctgtgcgggagcacacttgtccctgtggaatgtcaatggacagcccctggccagcatcaccacagcctggggcccagaaggagccataacctgctgctgcctgatggagggcccagcatgggacacaagccagatcatcatcaccgggagtcaagacggcatggtccgggtttggaagactgaggatgtgaagatgtctgttcctggtctgcagatgggtaggaagagagaggcagcagaggctctggcacaacagtgccaggctgagggtggcagaggtgactggggcctgagctctgcctacagaagaaacccccagggcctccttccccacagttctcaaggaagggcctctggcaatcacagctctgcagcccaaccctctccatggccgatgggacttctatgaaaaggatgagcacacacactcggagggctgagcagcacgctggaaactgtgacttggtgatgcccagctgcacacgaaattacacatgactcaccttattaagggctattgcactgaaaaaaaaaaagatgggtcgcttactggaaattattgtattgtctttattttattaaagcaactatgttttaaatgca

SEQ ID NO: 34404 - DNA, 9962 bp, Homo sapiens
ctgaattcagatctgctttgccacggcatggaggcagaagatctttcaaaggctgaagacagaaatgaagacccaggttccaaaaatgaagggcagcttgctgctgtgcagcctgatgtcccacatggagggcagtcctccagccccacagctctctgggacatgctggaaaggaagtttctggaataccagcagttgactcacaagagccccattgagcgtcagaagagcctgttgagtcttctccccctattcctaaaggcctgggaacactccgtggggatcatctgctttcccagtctccaaaggctggctgaagacgtgtctgaccagcttgcccagcaactccagaaggcccttgtggggaagcctgcggagcaagctcggttggcagctggacagttgctgtggtggaagggggacgtggatcaggatggctacttgctcctgaagtcagtgtacgtgctcacggggacagactcggagacgctgggcagggttgctgagtctgggcttccagccctgctcctacagtgcctttacctcttctttgtctttcctctggacaaagatgagcttcttgagagtgatcttcaagttcaaaagatgttcgtgcagatgttgctcaatatttgcagtgactctcagggcctggagggactcctctcaggaagtgagctgcagtctctgctgattgccacgacctgccttcgggagcacagctgctgcttctggaaggaacccaccttctgcgtgctaagggcaatctccaaggcccagaacctcagcatcatccagtacctgcaggccacagactgtgtcaggctctccctccagaacctctccaggctcacggacactctccctgcccctgaagtgagcgaggctgtaagcctgatcttgggattcgtgaaggactcctaccccgtctcctcggctctgttcctggagtttgagaattcagagggctatcctctgctgctcaaagtgttacttcggtatgatgggctgacccagagcgaagtggacccgcatctggaggagctccttgggctggtggtgtggctgacaacctgtgggaggtcagagctgaaggtgtttgacagcatcacttaccctcagcttgaaggcttcaagttccatcatgaggcatctggggtgactgttaagaatcttcaggccttccaggtcctacagaatgttttccacaaagccagtgactctgtcctctgcatacaagtcttgtcagtcatcaggaccatgtgggcctggaatgctcgaaacttcttcctgctggagtggaccctgcagcccatctcgcagtttgtagagatcatgcccctgaagccggccccagtgcaggaacacttcttccagcttctagaggccctggtgttcgagctgcactacgtgcctcatgagatcctgcgaaaggtacagcatctgatcaaggagagccctgggccatcctgcaccctcatggccctgcagagcatcctcagcatcgctggtggggaccccctcttcaccgacatcttccgggactcagggctcctgggcctgctactggcacagcttcggaagcaagccaagatcatgaggaagtcaggaaacaaagtgtccactcctggtgttcaggatccagaaagagaactcacctgtgtgatgctgaggattgtagtcacacttctgaaaggctcggtgaggaatgcagttgtcctgaaggaccacggcatggtgcccttcatcaagatcttcctggatgacgagtgctaccgggaggcctcgctcagcatcttggagcagctctcagccatcaacgccgaggagtacatgagcatcattgtgggtgctctatgctcatccactcaaggggagctgcagctgaaactggatctcctgaagtctctgctccggatcctggtgacccccaagggtcgtgctgccttcagagtctccagcgggttcaacgggctgctgtctctgctctctgacctggaaggctccctccaggagcccccgctgcaggcatggggagcagtatcccccagacagaccctggagctggttttgtacactctctgtgctgtgtccgcagcgctgcactgggaccctgtcaatggctacttcttcaggaggaatgggctctttgagaagctggccgaggacctctgcctgctgggctgttttggagccctggaggaagagggcaacctgctgcgctcttgggtggacacaaaggccaggccatttgcagatttgctgggcactgccttttcctccagcggctcactcccaccccggatacagagctgcctccagatccttggctttctggacagcatggccagcggcaccctccacttgcgtggggacctgaaggagtccctgaggaccaagcaggggccggttgtggatgttcagaagggagaaactggcagtgacccccaacgcaacttcaagcagtggccagacctggaggagaggatggatgagggagatgctgcaatcatgcatcccggggtcgtgtgcatcatggtgaggctgctgcctcggttgtaccatgaagatcacccacagctttccgaggagatccagtgctccctggccagtcatatccagtccctggtgaagtcggagaagaaccgccaggtcatgtgcgaagcaggcttgcttgggaccctcatggcctcctgccacagggccctggtcaccagtggcagccccctccactcacgcctcatcaggatctttgagaagctcgcttcccaggccattgaaccggatgtgctaagacagtttctaggtcttggaattccctcatctctgtcggccacaacaaaaatccttgattcatctcacacacacagaggcaaccctgggtgctcagggtcacagactgcacagggcttggctgaggggccctggccagctgccccagatgctgggctgcaccctggagtcacacaggccccgcagcccttgggggaatcccaggattcaactactgctcttcagacggcgctgagcctcatctccatgacctccccacgcaacctgcagcctcagagggcagccctggccccatcgtttgtggaatttgacatgtccgtggaaggttatggctgtttgtttattccaaccctgtccacagttatgggaaccagcactgagtactctgtctctggaggaattgggacaggtgccaccagaccgttccctcctcctggaggtctgaccttctcctgctggttcctgatcagccggcatggagctgccactgagggccacccgctgcgcttcctgacgttggtgcgccacctggccaggactgagcaaccctttgtttgcttctccgtcagcctctgcccagacgacctctccttggttgtttctacagaagagaaggagtttcagcctctggatgtcatggaacctgaggatgactccgagccttctgcaggatgccagcttcaggtcaggtgtggccagctcctggcttgtggtcagtggcatcacttggctgtggttgtcactaaggaaatgaaaaggcattgtacagtttccacctgtctggatggacaggtcattggctctgccaagatgttatacatccaggctctaccagggcctttcctttctatggatccatccgcatttgtggatgtttatggatatattgctactcctcgagtctggaaacaaaagtcttcattaatctggcgtcttggccccacatacctctttgaagaagccatttcaatggaaactctggaagttattaacaaacttggcccaagatattgtggtaacttccaagctgtgcatgtccaaggggaggacctggacagtgaagccacgccctttgttgcagaagaaagagtttcttttggacttcacatagccagctcctctatcaccagtgtagcggacatcagaaatgcttacaatgaggtggacagccgcctgatcgccaaagagatgaacatttcatcccgtgacaatgccatgcccgtgttcttgctgaggaattgtgctggccacctgtcagggtctctgcggaccattggagctgttgctgtgggtcaattaggggtgagggtattccactccagccctgctgccagcagcctggacttcattggcgggcctgccatcctcctgggcctcatctccttagcgacagatgaccataccatgtatgcggctgtgaaagttctgcactcggtcctgaccagtaatgccatgtgtgacttcctgatgcaacacatctgtgggtaccagataatggcgtttctcctgaggaagaaggcctctctcctgaaccatcgaatttttcagctgatcctctcagtggctggcactgtggagctgggcttcaggtcatctgctatcaccaacactggtgtcttccagcacatcctctgcaatttcgagctctggatgaatactgcagacaatctggagctcagcctcttttcccatcttttggaaatccttcaatcaccaagggaaggacccaggaatgctgaagctgcccaccaggcacagcttatacccaagctcatcttcctattcaatgagccgagcctcatcccctccaagatctccaccatcattggcatcctggcctgtcagctgaggggccacttcagcacccaggacttgctcaggattgggctgtttgttgtgtacaccctcaagccttcgtcggtgaatgagaggcagatctgcatggacggagccctggacccttccctgcctgctggaagccaaacatctggaaagacaatctggctcagaaaccagttgctggagatgctgctcagtgtaatatcttccccccagcttcatctgtcctctgagtcaaaggaagagatgtttctgaaactggggcctgactggttcctgctgctcctgcagggccacctgcatgccagcaccactgtgctggcattgaagctgctgctgtactttctggcaagcccctccctccgcacacggtttagagatggcctgtgtgcaggatcctgggtggaacgcagcactgagggcgtggatattgtaatggacaacctgaagagccagtcaccactgcctgagcaaagcccatgcctgcttcctgggttccgtgtcttgaatgactttctggcccaccacgtccacattccagaggtctacctcatcgtctccaccttcttcctgcagacaccactcacagagctgatggacgggcccaaagacagccttgatgccatgcttcagtggctcctgcagaggcaccaccaggaagaagtcctccaggctgggctgtgcacagaaggtgccttgctcctcctggaaatgctgaaggccaccatgagccagcccctggcaggttctgaggatggtgcctgggcacagaccttcccggccagcgtgctgcagttcctcagcctcgtccaccgcacctacccccaggacccagcgtggcgagccccggagttcctccagaccttggccatagccgccttccccctgggagcccaaaagggggttggggctgagtccacccggaacaccagcagtcctgaggccgcagctgaaggcgacagcacagtggagggtctccaggctcccaccaaggcacatcccgcccggaggaagctgagggagttcacgcagctcctcttgagggagctcctgcttggagcctccagccccaagcagtggctgcccctggaggtgctcctggaggcttctccagaccacgccaccagccaacagaagcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtggtcattgagactgcctcttctcaaagggacactgtcctcagcactttatacagcagtttaaataaagtcattctttattgcctatccaagccccagcagtccctctccgaatgcctcggccttctcagcatcctgggctttctgcaggagcactgggatgttgtctttgccacctacaattccaacatcagcttcctcctgtgtctcatgcattgccttttgctactcaatgagagaagttacccagaaggatttggattggagcccaagcctagaatgtctacttatcatcaagtcttcctttccccaaatgaagacgtgaaagaaaaaagagaagacttaccaagtttgagtgatgtccaacacaacatccagaagacagtgcagactctctggcagcagctggtggcacaaaggcagcagaccctggaggatgccttcaagatcgatctctctgtgaaacctggagagagggaagtgaagattgaagaggtcacaccgctctgggaggagacgatgctcaaggcctggcagcattacttagcatctgagaagaagtcactggcaagtcgttcaaatgttgcacaccacagcaaagtcactttgtggagtggaagcctgtcctcagccatgaagctgatgcccgggcggcaggccaaggaccctgagtgcaagacagaggattttgtgtcatgtatagagaactacagaagaagaggacaagagctatatgcatctttatacaaagaccatgtgcaaaggcgaaaatgtggcaacatcaaggcagccaacgcctgggccaggatccaggagcagctttttggggagctgggcttgtggagccagggggaagaaaccaagccctgttccccatgggaactcgactggagagaaggaccagctcgaatgaggaaacgcatcaaacgcttgtctcctttggaggccctgagctcaggaaggcacaaggaaagccaagacaaaaatgatcatatttctcaaacaaatgctgaaaaccaagatgaactgacactgagggaggctgagggcgagccggacgaggtgggggtggactgcacccagctgaccttcttcccagccttacacgaaagtctgcactcagaagacttcttggaactgtgtcgggaaagacaagttattttacaagagcttcttgataaagaaaaggtgacgcagaagttctccctggtgattgtgcagggccacctggtgtcagaaggggtcctgctttttggccaccaacacttctacatctgcgagaacttcacactgtctcccacgggtgatgtctactgtacccgtcactgcttatccaacatcagcgatccgttcattttcaacctgtgcagcaaagacaggtccactgaccattactcgtgccagtgccacagctacgctgacatgcgggagctacggcaggctcgcttcctcctgcaggacatcgccctggagatcttcttccacaatggatattccaagtttcttgtcttctacaacaatgatcggagtaaggcctttaaaagcttctgctctttccaacccagcctgaaggggaaagccacctcggaggacaccctcagtctaaggagataccccggctctgacaggatcatgctgcagaagtggcagaaaagggacatcagcaattttgagtatctcatgtacctcaacaccgcggctgggagaacctgcaatgactacatgcagtacccagtgttcccctgggtcctcgcagactacacctcagagacattgaacttggcaaatccgaagattttccgggatctttcaaagcccatgggggctcagaccaaggaaaggaagctgaaatttatccagaggtttaaagaagttgagaaaactgaaggagacatgactgtccagtgccactactacacccactactcctcggccatcatcgtggcctcctacctggtccggatgccacccttcacccaggccttctgcgctctgcagggcggaagcttcgacgtggcagacagaatgttccacagtgtgaagagcacgtgggagtcggcctccagagagaacatgagtgacgtcagggagctgaccccagagttcttctacctgcctgagttcttaaccaactgcaacggggtagagttcggctgcatgcaggacgggactgtgctaggagacgtgcagctccctccctgggctgatggggaccctcggaaattcatcagcctgcacagaaaggccctggaaagtgactttgtcagtgccaacctccaccattggatagaccttatttttgggtacaagcagcaggggccagccgcagtggatgctgttaatatcttccacccctacttctacggtgacagaatggacctcagcagcatcactgaccccctcatcaaaagcaccatcctggggtttgtcagcaactttggacaggtgcccaaacagctctttaccaaacctcacccagccaggactgcagcagggaagcctctgcctggaaaggatgtctccacccccgtgagcctgcctggccacccacagccctttttctacagcctgcagtcgctgaggccctcccaggtcacggtcaaagatatgtacctcttttctctaggctcagagtcccccaaaggggccattggccacattgtctctactgagaagaccattctggctgtagagaggaacaaagtgctgctgcctcctctctggaacaggaccttcagctggggctttgatgacttcagctgctgcttggggagctacggctccgacaaggtcctgatgacattcgagaacctggctgcctggggccgctgtctgtgcgccgtgtgcccatccccaacaacgattgtcacctctgggaccagcactgtggtgtgtgtgtgggagctcagcatgaccaaaggccgcccgaggggcttgcgcctccggcaggccttgtatggacacacacaggctgtcacgtgcctggcagcgtcagtcaccttcagcctcctggtgagcggctcccaggactgcacctgtatcctgtgggatctggaccacctcacccacgtgacccgcctgcccgcccatcgggaaggcatctcagccatcaccatcagtgacgtctcaggcaccattgtctcctgtgcgggagcacacttgtccctgtggaatgtcaatggacagcccctggccagcatcaccacagcctggggcccagaaggagccataacctgctgctgcctgatggagggcccagcatgggacacaagccagatcatcatcaccgggagtcaagacggcatggtccgggtttggaagactgaggatgtgaagatgtctgttcctggacggccagcaggagaggagcccccggctcagcctccaagcccaagaggccacaagtgggagaagaacctggccttgagtcgagagctggacgttagcattgctttgacagggaagcccagcaaaaccagccccgcagtgactgctctggccgtgtccagaaaccacaccaaactcctggttggtgatgagagggggagaatattctgctggtctgcagatgggtaggaagagagaggcagcagaggctctggcacaacagtgccaggctgagggtggcagaggtgactggggcctgagctctgcctacagaagaaacccccagggcctccttccccacagttctcaaggaagggcctctggcaatcacagctctgcagcccaaccctctccatggccgatgggacttctatgaaaaggatgagcacacacactcggagggctgagcagcacgctggaaactgtgacttggtgatgcccagctgcacacgaaattacacatgactcaccttattaagggctattgcactgaaaaaaaaaaagatgggtcgcttactggaaattattgtattgtctttattttattaaagcaactatgttttaaatgc

SEQ ID NO: 34405 - DNA, 2193 bp, Homo sapiens
gtgaaacggcgctgaggactgacgatgtggggccgggtcctcttcccccgagcctgaggggctgcagctggggatagggggcccatgccttctgatgtctacaggcgctgacggccacccctccagatctgctttgccacggcatggaggcagaagatctttcaaaggctgaagacagaaatgaagacccaggttccaaaaatgaagggcagcttgctgctgtgcagcctgatgtcccacatggagggcagtcctccagccccacagctctctgggacatgctggaaaggaagtttctggaataccagcagttgactcacaagagccccattgagcgtcagaagagcctgttgagtcttctccccctattcctaaaggcctgggaacactccgtggggatcatctgctttcccagtctccaaaggctggctgaagacgtgtctgaccagcttgcccagcaactccagaaggcccttgtggggaagcctgcggagcaagctcggttggcagctggacagttgctgtggtggaagggggacgtggatcaggatggctacttgctcctgaagtcagtgtacgtgctcacggggacagactcggagacgctgggcagggttgctgagtctgggcttccagccctgctcctacagtgcctttacctcttctttgtctttcctctggacaaagatgagcttcttgagagtgatcttcaagttcaaaagatgttcgtgcagatgttgctcaatatttgcagtgactctcagggcctggagggactcctctcaggaagtgagctgcagtctctgctgattgccacgacctgccttcgggagcacagctgctgcttctggaaggaacccaccttctgcgtgctaagggcaatctccaaggcccagaacctcagcatcatccagtacctgcaggccacagactgtgtcaggctctccctccagaacctctccaggctcacggacactctccctgcccctgaagtgagcgaggctgtaagcctgatcttgggattcgtgaaggactcctaccccgtctcctcggctctgttcctggagtttgagaattcagagggctatcctctgctgctcaaagtgttacttcggtatgatgggctgacccagagcgaagtggacccgcatctggaggagctccttgggctggtggtgtggctgacaacctgtgggaggtcagagctgaaggtgtttgacagcatcacttaccctcagcttgaaggcttcaagttccatcatgaggcatctggggtgactgttaagaatcttcaggccttccaggtcctacagaatgttttccacaaagccagtgactctgtcctctgcatacaagtcttgtcagtcatcaggaccatgtgggcctggaatgctcgaaacttcttcctgctggagtggaccctgcagcccatctcgcagtttgtagagatcatgcccctgaagccggccccagtgcaggaacacttcttccagcttctagaggccctggtgttcgagctgcactacgtgcctcatgagatcctgcgaaaggtacagcatctgatcaaggagagccctgggccatcctgcaccctcatggccctgcagagcatcctcagcatcgctggtggggaccccctcttcaccgacatcttccgggactcagggctcctgggcctgctactggcacagcttcggaagcaagccaagatcatgaggaagtcaggaaacaaagtgtccactcctggtgttcaggatccagaaagagaactcacctgtgtgatgctgaggattgtagtcacacttctgaaaggctcggtgaggaatgcagttgtcctgaaggaccacggcatggtgcccttcatcaagatcttcctggatgacgagtgctaccgggaggcctcgctcagcatcttggagcagctctcagccatcaacgccgaggagtacatgagcatcattgtgggtgctctatgctcatccactcaaggggagctgcagctgaaactggatctcctgaaggtgatttcaagtcctcctttgagattggcttccctgtggatatgcaccaagcgatccacatttgctcaggcatttgtattcatgtaattcagttagccactgtatgtggcaggcagtaccctgtattaggtagcgtcaggtgctgtaacaaataaatcccatatcctcagta

SEQ ID NO: 34406 - DNA, 2609 bp, Homo sapiens
agatgacactgtggtttgggctgaagaatgtgttgcctgcgcaaattggctctggatgaatactgcagacaatctggagctcagcctcttttcccatcttttggaaatccttcaatcaccaagggaaggacccaggaatgctgaagctgcccaccaggcacagcttatacccaagctcatcttcctattcaatgagccgagcctcatcccctccaagatctccaccatcattggcatcctggcctgtcagctgaggggccacttcagcacccaggacttgctcaggattgggctgtttgttgtgtacaccctcaagccttcgtcggtgaatgagaggcagatctgcatggacggagccctggacccttccctgcctgctggaagccaaacatctggaaagacaatctggctcagaaaccagttgctggagatgctgctcagtgtaatatcttccccccagcttcatctgtcctctgagtcaaaggaagagatgtttctgaaactggggcctgactggttcctgctgctcctgcagggccacctgcatgccagcaccactgtgctggcattgaagctgctgctgtactttctggcaagcccctccctccgcacacggtttagagatggcctgtgtgcaggatcctgggtggaacgcagcactgagggcgtggatattgtaatggacaacctgaagagccagtcaccactgcctgagcaaagcccatgcctgcttcctgggttccgtgtcttgaatgactttctggcccaccacgtccacattccagaggtctacctcatcgtctccaccttcttcctgcagacaccactcacagagctgatggacgggcccaaagacagccttgatgccatgcttcagtggctcctgcagaggcaccaccaggaagaagtcctccaggctgggctgtgcacagaaggtgccttgctcctcctggaaatgctgaaggccaccatgagccagcccctggcaggttctgaggatggtgcctgggcacagaccttcccggccagcgtgctgcagttcctcagcctcgtccaccgcacctacccccaggacccagcgtggcgagccccggagttcctccagaccttggccatagccgccttccccctgggagcccaaaagggggttggggctgagtccacccggaacaccagcagtcctgaggccgcagctgaaggcgacagcacagtggagggtctccaggctcccaccaaggcacatcccgcccggaggaagctgagggagttcacgcagctcctcttgagggagctcctgcttggagcctccagccccaagcagtggctgcccctggaggtgctcctggaggcttctccagaccacgccaccagccaacagaagcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtgatctcagccccattacaagctagagacttttcctgacaagcctccaggaaacctttgctcaaaccctccctgtgatggggaaccccctaaaattcaagttgtcccacccagggggatgtctgtgattcttggaaagaactttctgttatcaagctgggatctacctccagcaactcctgccagcagtcctggttatgccctctgcagcagaattaggaggaccactctccttcctcttcacatctcatagagagtgaaattggctcccagcacccttctgactgcagagtcacccacagacctcaggactgggcctcttcacagtttctagagccatcttcacttgtctgatgagcaggtccaagcaaacctggaaagacttgaattcaaaggcttcttcaggaacaactccaagagaggagaaatagcccttgtcagctctgtgagggttaaaatcagattcctggcaagttgtgttgtaaatggaaagaagctgctgagctccctatggctaaagcatggactcccagctaatatcccaaacataggtgccagtgggggccaccgtgctttcagggggaccaggcctgagggctcggctccccacatatccaccagcctcctctcttgcttgctgtctgtgatgcctgcccctcttaacctctgtttgagacccatctgaggagcaggagaggaacatgataaagaaatgaatcccaaaccccaacaggtttaaacagaccttcacttcatgagtagaaacattgcgttacctgtgaaattctaagggagtagcctataacaaattcattttctatcggactgaaaaactttgtgcatactctttgtattatggattcttttcatggaagccaaacagatgtttggagatgtatggaccagtccatgctaaggctacaaatcagggtcttctacttctccctctaagtttcttttgaattaaaatcttctggactccgtctccagt

SEQ ID NO: 34407 - DNA, 8253 bp, Homo sapiens
ctgaattcagatctgctttgccacggcatggaggcagaagatctttcaaaggctgaagacagaaatgaagacccaggttccaaaaatgaagggcagcttgctgctgtgcagcctgatgtcccacatggagggcagtcctccagccccacagctctctgggacatgctggaaaggaagtttctggaataccagcagttgactcacaagagccccattgagcgtcagaagagcctgttgagtcttctccccctattcctaaaggcctgggaacactccgtggggatcatctgctttcccagtctccaaaggctggctgaagacgtgtctgaccagcttgcccagcaactccagaaggcccttgtggggaagcctgcggagcaagctcggttggcagctggacagttgctgtggtggaagggggacgtggatcaggatggctacttgctcctgaagtcagtgtacgtgctcacggggacagactcggagacgctgggcagggttgctgagtctgggcttccagccctgctcctacagtgcctttacctcttctttgtctttcctctggacaaagatgagcttcttgagagtgatcttcaagttcaaaagatgttcgtgcagatgttgctcaatatttgcagtgactctcagggcctggagggactcctctcaggaagtgagctgcagtctctgctgattgccacgacctgccttcgggagcacagctgctgcttctggaaggaacccaccttctgcgtgctaagggcaatctccaaggcccagaacctcagcatcatccagtacctgcaggccacagactgtgtcaggctctccctccagaacctctccaggctcacggacactctccctgcccctgaagtgagcgaggctgtaagcctgatcttgggattcgtgaaggactcctaccccgtctcctcggctctgttcctggagtttgagaattcagagggctatcctctgctgctcaaagtgttacttcggtatgatgggctgacccagagcgaagtggacccgcatctggaggagctccttgggctggtggtgtggctgacaacctgtgggaggtcagagctgaaggtgtttgacagcatcacttaccctcagcttgaaggcttcaagttccatcatgaggcatctggggtgactgttaagaatcttcaggccttccaggtcctacagaatgttttccacaaagccagtgactctgtcctctgcatacaagtcttgtcagtcatcaggaccatgtgggcctggaatgctcgaaacttcttcctgctggagtggaccctgcagcccatctcgcagtttgtagagatcatgcccctgaagccggccccagtgcaggaacacttcttccagcttctagaggccctggtgttcgagctgcactacgtgcctcatgagatcctgcgaaaggtacagcatctgatcaaggagagccctgggccatcctgcaccctcatggccctgcagagcatcctcagcatcgctggtggggaccccctcttcaccgacatcttccgggactcagggctcctgggcctgctactggcacagcttcggaagcaagccaagatcatgaggaagtcaggaaacaaagtgtccactcctggtgttcaggatccagaaagagaactcacctgtgtgatgctgaggattgtagtcacacttctgaaaggctcggtgaggaatgcagttgtcctgaaggaccacggcatggtgcccttcatcaagatcttcctggatgacgagtgctaccgggaggcctcgctcagcatcttggagcagctctcagccatcaacgccgaggagtacatgagcatcattgtgggtgctctatgctcatccactcaaggggagctgcagctgaaactggatctcctgaagtctctgctccggatcctggtgacccccaagggtcgtgctgccttcagagtctccagcgggttcaacgggctgctgtctctgctctctgacctggaaggctccctccaggagcccccgctgcaggcatggggagcagtatcccccagacagaccctggagctggttttgtacactctctgtgctgtgtccgcagcgctgcactgggaccctgtcaatggctacttcttcaggaggaatgggctctttgagaagctggccgaggacctctgcctgctgggctgttttggagccctggaggaagagggcaacctgctgcgctcttgggtggacacaaaggccaggccatttgcagatttgctgggcactgccttttcctccagcggctcactcccaccccggatacagagctgcctccagatccttggctttctggacagcatggccagcggcaccctccacttgcgtggggacctgaaggagtccctgaggaccaagcaggggccggttgtggatgttcagaagggagaaactggcagtgacccccaacgcaacttcaagcagtggccagacctggaggagaggatggatgagggagatgctgcaatcatgcatcccggggtcgtgtgcatcatggtgaggctgctgcctcggttgtaccatgaagatcacccacagctttccgaggagatccagtgctccctggccagtcatatccagtccctggtgaagtcggagaagaaccgccaggtcatgtgcgaagcaggcttgcttgggaccctcatggcctcctgccacagggccctggtcaccagtggcagccccctccactcacgcctcatcaggatctttgagaagctcgcttcccaggccattgaaccggatgtgctaagacagtttctaggtcttggaattccctcatctctgtcggccacaacaaaaatccttgattcatctcacacacacagaggcaaccctgggtgctcagggtcacagactgcacagggcttggctgaggggccctggccagctgccccagatgctgggctgcaccctggagtcacacaggccccgcagcccttgggggaatcccaggattcaactactgctcttcagacggcgctgagcctcatctccatgacctccccacacatctggaagccaaacatctggaaagacaatctggctcagaaaccagttgctggagatgctgctcagtgtaatatcttccccccagcttcatctgtcctctgagtcaaaggaagagatgtttctgaaactggggcctgactggttcctgctgctcctgcagggccacctgcatgccagcaccactgtgctggcattgaagctgctgctgtactttctggcaagcccctccctccgcacacggtttagagatggcctgtgtgcaggatcctgggtggaacgcagcactgagggcgtggatattgtaatggacaacctgaagagccagtcaccactgcctgagcaaagcccatgcctgcttcctgggttccgtgtcttgaatgactttctggcccaccacgtccacattccagaggtctacctcatcgtctccaccttcttcctgcagacaccactcacagagctgatggacgggcccaaagacagccttgatgccatgcttcagtggctcctgcagaggcaccaccaggaagaagtcctccaggctgggctgtgcacagaaggtgccttgctcctcctggaaatgctgaaggccaccatgagccagcccctggcaggttctgaggatggtgcctgggcacagaccttcccggccagcgtgctgcagttcctcagcctcgtccaccgcacctacccccaggacccagcgtggcgagccccggagttcctccagaccttggccatagccgccttccccctgggagcccaaaagggggttggggctgagtccacccggaacaccagcagtcctgaggccgcagctgaaggcgacagcacagtggagggtctccaggctcccaccaaggcacatcccgcccggaggaagctgagggagttcacgcagctcctcttgagggagctcctgcttggagcctccagccccaagcagtggctgcccctggaggtgctcctggaggcttctccagaccacgccaccagccaacagaagcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtggtcattgagactgcctcttctcaaagggacactgtcctcagcactttatacagcagtttaaataaagtcattctttattgcctatccaagccccagcagtccctctccgaatgcctcggccttctcagcatcctgggctttctgcaggagcactgggatgttgtctttgccacctacaattccaacatcagcttcctcctgtgtctcatgcattgccttttgctactcaatgagagaagttacccagaaggatttggattggagcccaagcctagaatgtctacttatcatcaagtcttcctttccccaaatgaagacgtgaaagaaaaaagagaagacttaccaagtttgagtgatgtccaacacaacatccagaagacagtgcagactctctggcagcagctggtggcacaaaggcagcagaccctggaggatgccttcaagatcgatctctctgtgaaacctggagagagggaagtgaagattgaagaggtcacaccgctctgggaggagacgatgctcaaggcctggcagcattacttagcatctgagaagaagtcactggcaagtcgttcaaatgttgcacaccacagcaaagtcactttgtggagtggaagcctgtcctcagccatgaagctgatgcccgggcggcaggccaaggaccctgagtgcaagacagaggattttgtgtcatgtatagagaactacagaagaagaggacaagagctatatgcatctttatacaaagaccatgtgcaaaggcgaaaatgtggcaacatcaaggcagccaacgcctgggccaggatccaggagcagctttttggggagctgggcttgtggagccagggggaagaaaccaagccctgttccccatgggaactcgactggagagaaggaccagctcgaatgaggaaacgcatcaaacgcttgtctcctttggaggccctgagctcaggaaggcacaaggaaagccaagacaaaaatgatcatatttctcaaacaaatgctgaaaaccaagatgaactgacactgagggaggctgagggcgagccggacgaggtgggggtggactgcacccagctgaccttcttcccagccttacacgaaagtctgcactcagaagacttcttggaactgtgtcgggaaagacaagttattttacaagagcttcttgataaagaaaaggtgacgcagaagttctccctggtgattgtgcagggccacctggtgtcagaaggggtcctgctttttggccaccaacacttctacatctgcgagaacttcacactgtctcccacgggtgatgtctactgtacccgtcactgcttatccaacatcagcgatccgttcattttcaacctgtgcagcaaagacaggtccactgaccattactcgtgccagtgccacagctacgctgacatgcgggagctacggcaggctcgcttcctcctgcaggacatcgccctggagatcttcttccacaatggatattccaagtttcttgtcttctacaacaatgatcggagtaaggcctttaaaagcttctgctctttccaacccagcctgaaggggaaagccacctcggaggacaccctcagtctaaggagataccccggctctgacaggatcatgctgcagaagtggcagaaaagggacatcagcaattttgagtatctcatgtacctcaacaccgcggctgggagaacctgcaatgactacatgcagtacccagtgttcccctgggtcctcgcagactacacctcagagacattgaacttggcaaatccgaagattttccgggatctttcaaagcccatgggggctcagaccaaggaaaggaagctgaaatttatccagaggtttaaagaagttgagaaaactgaaggagacatgactgtccagtgccactactacacccactactcctcggccatcatcgtggcctcctacctggtccggatgccacccttcacccaggccttctgcgctctgcagggcggaagcttcgacgtggcagacagaatgttccacagtgtgaagagcacgtgggagtcggcctccagagagaacatgagtgacgtcagggagctgaccccagagttcttctacctgcctgagttcttaaccaactgcaacggggtagagttcggctgcatgcaggacgggactgtgctaggagacgtgcagctccctccctgggctgatggggaccctcggaaattcatcagcctgcacagaaaggccctggaaagtgactttgtcagtgccaacctccaccattggatagaccttatttttgggtacaagcagcaggggccagccgcagtggatgctgttaatatcttccacccctacttctacggtgacagaatggacctcagcagcatcactgaccccctcatcaaaagcaccatcctggggtttgtcagcaactttggacaggtgcccaaacagctctttaccaaacctcacccagccaggactgcagcagggaagcctctgcctggaaaggatgtctccacccccgtgagcctgcctggccacccacagccctttttctacagcctgcagtcgctgaggccctcccaggtcacggtcaaagatatgtacctcttttctctaggctcagagtcccccaaaggggccattggccacattgtctctactgagaagaccattctggctgtagagaggaacaaagtgctgctgcctcctctctggaacaggaccttcagctggggctttgatgacttcagctgctgcttggggagctacggctccgacaaggtcctgatgacattcgagaacctggctgcctggggccgctgtctgtgcgccgtgtgcccatccccaacaacgattgtcacctctgggaccagcactgtggtgtgtgtgtgggagctcagcatgaccaaaggccgcccgaggggcttgcgcctccggcaggccttgtatggacacacacaggctgtcacgtgcctggcagcgtcagtcaccttcagcctcctggtgagcggctcccaggactgcacctgtatcctgtgggatctggaccacctcacccacgtgacccgcctgcccgcccatcgggaaggcatctcagccatcaccatcagtgacgtctcaggcaccattgtctcctgtgcgggagcacacttgtccctgtggaatgtcaatggacagcccctggccagcatcaccacagcctggggcccagaaggagccataacctgctgctgcctgatggagggcccagcatgggacacaagccagatcatcatcaccgggagtcaagacggcatggtccgggtttggaagactgaggatgtgaagatgtctgttcctggacggccagcaggagaggagcccccggctcagcctccaagcccaagaggccacaagtgggagaagaacctggccttgagtcgagagctggacgttagcattgctttgacagggaagcccagcaaaaccagccccgcagtgactgctctggccgtgtccagaaaccacaccaaactcctggttggtgatgagagggggagaatattctgctggtctgcagatgggtaggaagagagaggcagcagaggctctggcacaacagtgccaggctgagggtggcagaggtgactggggcctgagctctgcctacagaagaaacccccagggcctccttccccacagttctcaaggaagggcctctggcaatcacagctctgcagcccaaccctctccatggccgatgggacttctatgaaaaggatgagcacacacactcggagggctgagcagcacgctggaaactgtgacttggtgatgcccagctgcacacgaaattacacatgactcaccttattaagggctattgcactgaaaaaaaaaaagatgggtcgcttactggaaattattgtattgtctttattttattaaagcaactatgttttaaatgc

SEQ ID NO: 34408 - DNA, 9558 bp, Homo sapiens
ctgaattcagatctgctttgccacggcatggaggcagaagatctttcaaaggctgaagacagaaatgaagacccaggttccaaaaatgaagggcagcttgctgctgtgcagcctgatgtcccacatggagggcagtcctccagccccacagctctctgggacatgctggaaaggaagtttctggaataccagcagttgactcacaagagccccattgagcgtcagaagagcctgttgagtcttctccccctattcctaaaggcctgggaacactccgtggggatcatctgctttcccagtctccaaaggctggctgaagacgtgtctgaccagcttgcccagcaactccagaaggcccttgtggggaagcctgcggagcaagctcggttggcagctggacagttgctgtggtggaagggggacgtggatcaggatggctacttgctcctgaagtcagtgtacgtgctcacggggacagactcggagacgctgggcagggttgctgagtctgggcttccagccctgctcctacagtgcctttacctcttctttgtctttcctctggacaaagatgagcttcttgagagtgatcttcaagttcaaaagatgttcgtgcagatgttgctcaatatttgcagtgactctcagggcctggagggactcctctcaggaagtgagctgcagtctctgctgattgccacgacctgccttcgggagcacagctgctgcttctggaaggaacccaccttctgcgtgctaagggcaatctccaaggcccagaacctcagcatcatccagtacctgcaggccacagactgtgtcaggctctccctccagaacctctccaggctcacggacactctccctgcccctgaagtgagcgaggctgtaagcctgatcttgggattcgtgaaggactcctaccccgtctcctcggctctgttcctggagtttgagaattcagagggctatcctctgctgctcaaagtgttacttcggtatgatgggctgacccagagcgaagtggacccgcatctggaggagctccttgggctggtggtgtggctgacaacctgtgggaggtcagagctgaaggtgtttgacagcatcacttaccctcagcttgaaggcttcaagttccatcatgaggcatctggggtgactgttaagaatcttcaggccttccaggtcctacagaatgttttccacaaagccagtgactctgtcctctgcatacaagtcttgtcagtcatcaggaccatgtgggcctggaatgctcgaaacttcttcctgctggagtggaccctgcagcccatctcgcagtttgtagagatcatgcccctgaagccggccccagtgcaggaacacttcttccagcttctagaggccctggtgttcgagctgcactacgtgcctcatgagatcctgcgaaaggtacagcatctgatcaaggagagccctgggccatcctgcaccctcatggccctgcagagcatcctcagcatcgctggtggggaccccctcttcaccgacatcttccgggactcagggctcctgggcctgctactggcacagcttcggaagcaagccaagatcatgaggaagtcaggaaacaaagtgtccactcctggtgttcaggatccagaaagagaactcacctgtgtgatgctgaggattgtagtcacacttctgaaaggctcggtgaggaatgcagttgtcctgaaggaccacggcatggtgcccttcatcaagatcttcctggatgacgagtgctaccgggaggcctcgctcagcatcttggagcagctctcagccatcaacgccgaggagtacatgagcatcattgtgggtgctctatgctcatccactcaaggggagctgcagctgaaactggatctcctgaagtctctgctccggatcctggtgacccccaagggtcgtgctgccttcagagtctccagcgggttcaacgggctgctgtctctgctctctgacctggaaggctccctccaggagcccccgctgcaggcatggggagcagtatcccccagacagaccctggagctggttttgtacactctctgtgctgtgtccgcagcgctgcactgggaccctgtcaatggctacttcttcaggaggaatgggctctttgagaagctggccgaggacctctgcctgctgggctgttttggagccctggaggaagagggcaacctgctgcgctcttgggtggacacaaaggccaggccatttgcagatttgctgggcactgccttttcctccagcggctcactcccaccccggatacagagctgcctccagatccttggctttctggacagcatggccagcggcaccctccacttgcgtggggacctgaaggagtccctgaggaccaagcaggggccggttgtggatgttcagaagggagaaactggcagtgacccccaacgcaacttcaagcagtggccagacctggaggagaggatggatgagggagatgctgcaatcatgcatcccggggtcgtgtgcatcatggtgaggctgctgcctcggttgtaccatgaagatcacccacagctttccgaggagatccagtgctccctggccagtcatatccagtccctggtgaagtcggagaagaaccgccaggtcatgtgcgaagcaggcttgcttgggaccctcatggcctcctgccacagggccctggtcaccagtggcagccccctccactcacgcctcatcaggatctttgagaagctcgcttcccaggccattgaaccggatgtgctaagacagtttctaggtcttggaattccctcatctctgtcggccacaacaaaaatccttgattcatctcacacacacagaggcaaccctgggtgctcagggtcacagactgcacagggcttggctgaggggccctggccagctgccccagatgctgggctgcaccctggagtcacacaggccccgcagcccttgggggaatcccaggattcaactactgctcttcagacggcgctgagcctcatctccatgacctccccacgcaacctgcagcctcagagggcagccctggccccatcgtttgtggaatttgacatgtccgtggaaggttatggctgtttgtttattccaaccctgtccacagttatgggaaccagcactgagtactctgtctctggaggaattgggacaggtgccaccagaccgttccctcctcctggaggtctgaccttctcctgctggttcctgatcagccggcatggagctgccactgagggccacccgctgcgcttcctgacgttggtgcgccacctggccaggactgagcaaccctttgtttgcttctccgtcagcctctgcccagacgacctctccttggttgtttctacagaagagaaggagtttcagcctctggatgtcatggaacctgaggatgactccgagccttctgcaggatgccagcttcaggtcaggtgtggccagctcctggcttgtggtcagtggcatcacttggctgtggttgtcactaaggaaatgaaaaggcattgtacagtttccacctgtctggatggacaggtcattggctctgccaagatgttatacatccaggctctaccagggcctttcctttctatggatccatccgcatttgtggatgtttatggatatattgctactcctcgagtctggaaacaaaagtcttcattaatctggcgtcttggccccacatacctctttgaagaagccatttcaatggaaactctggaagttattaacaaacttggcccaagatattgtggtaacttccaagctgtgcatgtccaaggggaggacctggacagtgaagccacgccctttgttgcagaagaaagagtttcttttggacttcacatagccagctcctctatcaccagtgtagcggacatcagaaatgcttacaatgaggtggacagccgcctgatcgccaaagagatgaacatttcatcccgtgacaatgccatgcccgtgttcttgctgaggaattgtgctggccacctgtcagggtctctgcggaccattggagctgttgctgtgggtcaattaggggtgagggtattccactccagccctgctgccagcagcctggacttcattggcgggcctgccatcctcctgggcctcatctccttagcgacagatgaccataccatgtatgcggctgtgaaagttctgcactcggtcctgaccagtaatgccatgtgtgacttcctgatgcaacacatctgtgggtaccagataatggcgtttctcctgaggaagaaggcctctctcctgaaccatcgaatttttcagctgatcctctcagtggctggcactgtggagctgggcttcaggtcatctgctatcaccaacactggtgtcttccagcacatcctctgcaatttcgagctctggatgaatactgcagacaatctggagctcagcctcttttcccatcttttggaaatccttcaatcaccaagggaaggacccaggaatgctgaagctgcccaccaggcacagcttatacccaagctcatcttcctattcaatgagccgagcctcatcccctccaagatctccaccatcattggcatcctggcctgtcagctgaggggccacttcagcacccaggacttgctcaggattgggctgtttgttgtgtacaccctcaagccttcgtcggtgaatgagaggcagatctgcatggacggagccctggacccttccctgcctgctggaagccaaacatctggaaagacaatctggctcagaaaccagttgctggagatgctgctcagtgtaatatcttccccccagcttcatctgtcctctgagtcaaaggaagagatgtttctgaaactggggcctgactggttcctgctgctcctgcagggccacctgcatgccagcaccactgtgctggcattgaagctgctgctgtactttctggcaagcccctccctccgcacacggtttagagatggcctgtgtgcaggatcctgggtggaacgcagcactgagggcgtggatattgtaatggacaacctgaagagccagtcaccactgcctgagcaaagcccatgcctgcttcctgggttccgtgtcttgaatgactttctggcccaccacgtccacattccagaggtctacctcatcgtctccaccttcttcctgcagacaccactcacagagctgatggacgggcccaaagacagccttgatgccatgcttcagtggctcctgcagaggcaccaccaggaagaagtcctccaggctgggctgtgcacagaaggtgccttgctcctcctggaaatgctgaaggccaccatgagccagcccctggcaggttctgaggatggtgcctgggcacagaccttcccggccagcgtgctgcagttcctcagcctcgtccaccgcacctacccccaggacccagcgtggcgagccccggagttcctccagaccttggccatagccgccttccccctgggagcccaaaagggggttggggctgagtccacccggaacaccagcagtcctgaggccgcagctgaaggcgacagcacagtggagggtctccaggctcccaccaaggcacatcccgcccggaggaagctgagggagttcacgcagctcctcttgagggagctcctgcttggagcctccagccccaagcagtggctgcccctggaggtgctcctggaggcttctccagaccacgccaccagccaacagaagcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtggtcattgagactgcctcttctcaaagggacactgtcctcagcactttatacagcagtttaaataaagtcattctttattgcctatccaagccccagcagtccctctccgaatgcctcggccttctcagcatcctgggctttctgcaggagcactgggatgttgtctttgccacctacaattccaacatcagcttcctcctgtgtctcatgcattgccttttgctactcaatgagagaagttacccagaaggatttggattggagcccaagcctagaatgtctacttatcatcaagtcttcctttccccaaatgaagacgtgaaagaaaaaagagaagacttaccaagtttgagtgatgtccaacacaacatccagaagacagtgcagactctctggcagcagctggtggcacaaaggcagcagaccctggaggatgccttcaagatcgatctctctgtgaaacctggagagagggaagtgaagattgaagaggtcacaccgctctgggaggagacgatgctcaaggcctggcagcattacttagcatctgagaagaagtcactggcaagtcgttcaaatgttgcacaccacagcaaagtcactttgtggagtggaagcctgtcctcagccatgaagctgatgcccgggcggcaggccaaggaccctgagtgcaagacagaggattttgtgtcatgtatagagaactacagaagaagaggacaagagctatatgcatctttatacaaagaccatgtgcaaaggcgaaaatgtggcaacatcaaggcagccaacgcctgggccaggatccaggagcagctttttggggagctgggcttgtggagccagggggaagaaaccaagccctgttccccatgggaactcgactggagagaaggaccagctcgaatgaggaaacgcatcaaacgcttgtctcctttggaggccctgagctcaggaaggcacaaggaaagccaagacaaaaatgatcatatttctcaaacaaatgctgaaaaccaagatgaactgacactgagggaggctgagggcgagccggacgaggtgggggtggactgcacccagctgaccttcttcccagccttacacgaaagtctgcactcagaagacttcttggaactgtgtcgggaaagacaagttattttacaagagcttcttgataaagaaaaggtgacgcagaagttctccctggtgattgtgcagggccacctggtgtcagaaggggtcctgctttttggccaccaacacttctacatctgcgagaacttcacactgtctcccacgggtgatgtctactgtacccgtcactgcttatccaacatcagcgatccgttcattttcaacctgtgcagcaaagacaggtccactgaccattactcgtgccagtgccacagctacgctgacatgcgggagctacggcaggctcgcttcctcctgcaggacatcgccctggagatcttcttccacaatggatattccaagtttcttgtcttctacaacaatgatcggagtaaggcctttaaaagcttctgctctttccaacccagcctgaaggggaaagccacctcggaggacaccctcagtctaaggagataccccggctctgacaggatcatgctgcagaagtggcagaaaagggacatcagcaattttgagtatctcatgtacctcaacaccgcggctgggagaacctgcaatgactacatgcagtacccagtgttcccctgggtcctcgcagactacacctcagagacattgaacttggcaaatccgaagattttccgggatctttcaaagcccatgggggctcagaccaaggaaaggaagctgaaatttatccagaggtttaaagaagttgagaaaactgaaggagacatgactgtccagtgccactactacacccactactcctcggccatcatcgtggcctcctacctggtccggatgccacccttcacccaggccttctgcgctctgcagggcggaagcttcgacgtggcagacagaatgttccacagtgtgaagagcacgtgggagtcggcctccagagagaacatgagtgacgtcagggagctgaccccagagttcttctacctgcctgagttcttaaccaactgcaacggggtagagttcggctgcatgcaggacgggactgtgctaggagacgtgcagctccctccctgggctgatggggaccctcggaaattcatcagcctgcacagaaaggccctggaaagtgactttgtcagtgccaacctccaccattggatagaccttatttttgggtacaagcagcaggggccagccgcagtggatgctgttaatatcttccacccctacttctacggtgacagaatggacctcagcagcatcactgaccccctcatcaaaagcaccatcctggggtttgtcagcaactttggacaggtgcccaaacagctctttaccaaacctcacccagccaggactgcagcagggaagcctctgcctggaaaggatgtctccacccccgtgagcctgcctggccacccacagccctttttctacagcctgcagtcgctgaggccctcccaggtcacggtcaaagatatgtacctcttttctctaggctcagagtcccccaaaggggccattggccacattgtctctactgagaagaccattctggctgtagagaggaacaaagtgctgctgcctcctctctggaacaggaccttcagctggggctttgatgacttcagctgctgcttggggagctacggctccgacaaggtcctgatgacattcgagaacctggctgcctggggccgctgtctgtgcgccgtgtgcccatccccaacaacgattgtcacctctgggaccagcactgtggtgtgtgtgtgggagctcagcatgaccaaaggccgcccgaggggcttgcgcctccggcaggccttgtatggacacacacaggctgtcacgtgcctggcagcgtcagtcaccttcagcctcctggtgagcggctcccaggactgcacctgtatcctgtgggatctggaccacctcacccacgtgacccgcctgcccgcccatcgggaaggcatctcagccatcaccatcagtgacgtctcaggcaccattgtctcctgtgcgggagcacacttgtccctgtggaatgtcaatggacagcccctggccagcatcaccacagcctggggcccagaaggagccataacctgctgctgcctgatggagggcccagcatgggacacaagccagatcatcatcaccgggagtcaagacggcatggtccgggtttggaagactgaggatgtgaagatgtctgttcctggtctgcagatgggtaggaagagagaggcagcagaggctctggcacaacagtgccaggctgagggtggcagaggtgactggggcctgagctctgcctacagaagaaacccccagggcctccttccccacagttctcaaggaagggcctctggcaatcacagctctgcagcccaaccctctccatggccgatgggacttctatga

SEQ ID NO: 34409 - DNA, 3415 bp, Homo sapiens
ctgaattcagatctgctttgccacggcatggaggcagaagatctttcaaaggctgaagacagaaatgaagacccaggttccaaaaatgaagggcagcttgctgctgtgcagcctgatgtcccacatggagggcagtcctccagccccacagctctctgggacatgctggaaaggaagtttctggaataccagcagttgactcacaagagccccattgagcgtcagaagagcctgttgagtcttctccccctattcctaaaggcctgggaacactccgtggggatcatctgctttcccagtctccaaaggctggctgaagacgtgtctgaccagcttgcccagcaactccagaaggcccttgtggggaagcctgcggagcaagctcggttggcagctggacagttgctgtggtggaagggggacgtggatcaggatggctacttgctcctgaagtcagtgtacgtgctcacggggacagactcggagacgctgggcagggttgctgagtctgggcttccagccctgctcctacagtgcctttacctcttctttgtctttcctctggacaaagatgagcttcttgagagtgatcttcaagttcaaaagatgttcgtgcagatgttgctcaatatttgcagtgactctcagggcctggagggactcctctcaggaagtgagctgcagtctctgctgattgccacgacctgccttcgggagcacagctgctgcttctggaaggaacccaccttctgcgtgctaagggcaatctccaaggcccagaacctcagcatcatccagtacctgcaggccacagactgtgtcaggctctccctccagaacctctccaggctcacggacactctccctgcccctgaagtgagcgaggctgtaagcctgatcttgggattcgtgaaggactcctaccccgtctcctcggctctgttcctggagtttgagaattcagagggctatcctctgctgctcaaagtgttacttcggtatgatgggctgacccagagcgaagtggacccgcatctggaggagctccttgggctggtggtgtggctgacaacctgtgggaggtcagagctgaaggtgtttgacagcatcacttaccctcagcttgaaggcttcaagttccatcatgaggcatctggggtgactgttaagaatcttcaggccttccaggtcctacagaatgttttccacaaagccagtgactctgtcctctgcatacaagtcttgtcagtcatcaggaccatgtgggcctggaatgctcgaaacttcttcctgctggagtggaccctgcagcccatctcgcagtttgtagagatcatgcccctgaagccggccccagtgcaggaacacttcttccagcttctagaggccctggtgttcgagctgcactacgtgcctcatgagatcctgcgaaaggtacagcatctgatcaaggagagccctgggccatcctgcaccctcatggccctgcagagcatcctcagcatcgctggtggggaccccctcttcaccgacatcttccgggactcagggctcctgggcctgctactggcacagcttcggaagcaagccaagatcatgaggaagtcaggaaacaaagtgtccactcctggtgttcaggatccagaaagagaactcacctgtgtgatgctgaggattgtagtcacacttctgaaaggctcggtgaggaatgcagttgtcctgaaggaccacggcatggtgcccttcatcaagatcttcctggatgacgagtgctaccgggaggcctcgctcagcatcttggagcagctctcagccatcaacgccgaggagtacatgagcatcattgtgggtgctctatgctcatccactcaaggggagctgcagctgaaactggatctcctgaagtctctgctccggatcctggtgacccccaagggtcgtgctgccttcagagtctccagcgggttcaacgggctgctgtctctgctctctgacctggaaggctccctccaggagcccccgctgcaggcatggggagcagtatcccccagacagaccctggagctggttttgtacactctctgtgctgtgtccgcagcgctgcactgggaccctgtcaatggctacttcttcaggaggaatgggctctttgagaagctggccgaggacctctgcctgctgggctgttttggagccctggaggaagagggcaacctgctgcgctcttgggtggacacaaaggccaggccatttgcagatttgctgggcactgccttttcctccagcggctcactcccaccccggatacagagctgcctccagatccttggctttctggacagcatggccagcggcaccctccacttgcgtggggacctgaaggagtccctgaggaccaagcaggggccggttgtggatgttcagaagggagaaactggcagtgacccccaacgcaacttcaagcagtggccagacctggaggagaggatggatgagggagatgctgcaatcatgcatcccggggtcgtgtgcatcatggtgaggctgctgcctcggttgtaccatgaagatcacccacagctttccgaggagatccagtgctccctggccagtcatatccagtccctggtgaagtcggagaagaaccgccaggtcatgtgcgaagcaggcttgcttgggaccctcatggcctcctgccacagggccctggtcaccagtggcagccccctccactcacgcctcatcaggatctttgagaagctcgcttcccaggccattgaaccggatgtgctaagacagtttctaggtcttggaattccctcatctctgtcggccacaacaaaaatccttgattcatctcacacacacagaggcaaccctgggtgctcagggtcacagactgcacagggcttggctgaggggccctggccagctgccccagatgctgggctgcaccctggagtcacacaggccccgcagcccttgggggaatcccaggattcaactactgctcttcagacggcgctgagcctcatctccatgacctcccctgtagctggaagccaaacatctggaaagacaatctggctcagaaaccagttgctggagatgctgctcagtgtaatatcttccccccagcttcatctgtcctctgagtaagtagctccaggaagagcaatttggcaggaggttacctcatacagggtgtggcattaaaccttttcttaatgaaaagtttagcatctctgagtctgttttctgcaatgtatttcctgcactagtcagaaagaaaattatattctctctacccaatgaaccagaccttgccctaagatattctgatgcaaatgttaagtggacatgagtaactagaaacagatttggtataattacaataaactccttttgtcaccat

SEQ ID NO: 34410 - DNA, 2117 bp, Homo sapiens
attcctctgtcctcactcccctgtcaacttctaaaacagagtagcaagagcagcaggctgtggcaggccaactccacatgctcatggctctggagggctcagcacaggtccttttcaaggagataccccggctctgacaggatcatgctgcagaagtggcagaaaagggacatcagcaattttgagtatctcatgtacctcaacaccgcggctgggagaacctgcaatgactacatgcagtacccagtgttcccctgggtcctcgcagactacacctcagagacattgaacttggcaaatccgaagattttccgggatctttcaaagcccatgggggctcagaccaaggaaaggaagctgaaatttatccagaggtttaaagaagttgagaaaactgaaggagacatgactgtccagtgccactactacacccactactcctcggccatcatcgtggcctcctacctggtccggatgccacccttcacccaggccttctgcgctctgcagggcggaagcttcgacgtggcagacagaatgttccacagtgtgaagagcacgtgggagtcggcctccagagagaacatgagtgacgtcagggagctgaccccagagttcttctacctgcctgagttcttaaccaactgcaacggggtagagttcggctgcatgcaggacgggactgtgctaggagacgtgcagctccctccctgggctgatggggaccctcggaaattcatcagcctgcacagaaaggccctggaaagtgactttgtcagtgccaacctccaccattggatagaccttatttttgggtacaagcagcaggggccagccgcagtggatgctgttaatatcttccacccctacttctacggtgacagaatggacctcagcagcatcactgaccccctcatcaaaagcaccatcctggggtttgtcagcaactttggacaggtgcccaaacagctctttaccaaacctcacccagccaggactgcagcagggaagcctctgcctggaaaggatgtctccacccccgtgagcctgcctggccacccacagccctttttctacagcctgcagtcgctgaggccctcccaggtcacggtcaaagatatgtacctcttttctctaggctcagagtcccccaaaggggccattggccacattgtctctactgagaagaccattctggctgtagagaggaacaaagtgctgctgcctcctctctggaacaggaccttcagctggggctttgatgacttcagctgctgcttggggagctacggctccgacaaggtcctgatgacattcgagaacctggctgcctggggccgctgtctgtgcgccgtgtgcccatccccaacaacgattgtcacctctgggaccagcactgtggtgtgtgtgtgggagctcagcatgaccaaaggccgcccgaggggcttgcgcctccggcaggccttgtatggacacacacaggctgtcacgtgcctggcagcgtcagtcaccttcagcctcctggtgagcggctcccaggactgcacctgtatcctgtgggatctggaccacctcacccacgtgacccgcctgcccgcccatcgggaaggcatctcagccatcaccatcagtgacgtctcaggcaccattgtctcctgtgcgggagcacacttgtccctgtggaatgtcaatggacagcccctggccagcatcaccacagcctggggcccagaaggagccataacctgctgctgcctgatggagggcccagcatgggacacaagccagatcatcatcaccgggagtcaagacggcatggtccgggtttggaagactgaggatgtgaagatgtctgttcctggacggccagcaggagaggagcccccggctcagcctccaaccctctccatggccgatgggacttctatgaaaaggatgagcacacacactcggagggctgagcagcacgctggaaactgtgacttggtgatgcccagctgcacacgaaattacacatgactcaccttattaagggctattgcactgaaaaaaaaaaagatgggtcgcttactggaaattattgtattgtctttattttattaaagcaactatgtttt

SEQ ID NO: 34411 - DNA, 3061 bp, Homo sapiens
aatttcttttcaatattagcttattcccaaattggctaatgggtatttttaaagccatgctaaattaaaggaattcaattttctcactagtatttggtaacacatgggagactatgtgtcatatccagaagagttctgtacatgaactgcatttaattgctccgagagtcactggagctttctttaatcagaatggaaatcaggataagctgaggtcttatagattggtggtacttaaggcagaaaattaacaccgtgttttgtagctgttagttggtagagggaaattcaggctaccgtcgcgaaacctgcaggttaagttattttctcctccctgcttctgtaggttcacagcgttcccttctgatagagctttttgtctgtgttgtaaagctctttggctgagatggatgacaaagatattgacaaagaactaaggcagaaattaaacttttcctattgtgaggagactgagattgaagggcagaagaaagtagaagaaagcagggaggcttcgagccaaaccccagagaagggtgaagtgcaggattcagaggcaaagggtacaccaccttggactccccttagcaacgtgcatgagctcgacacatcttcggaaaaagacaaagaaagtccagatcagattttgaggactccagtgtcacaccctctcaaatgtcctgagacaccagcccaaccagacagcaggagcaagctgctgcccagtgacagcccctctactcccaaaaccatgctgagccggttggtgatttctccaacagggaagcttccttccagaggccctaagcatttgaagctcacacctgctcccctcaaggatgagatgacctcattggctctggtcaatattaatcccttcactccagagtcctataaaaaattatttcttcaatctggtggcaagaggaaaataagaggagatcttgaggaagctggtccagaggaaggcaagggagggctgcctgccaagagatgtgttttacgagaaaccaacatggcttcccgctatgaaaaagaattcttggaggttgaaaaaattggggttggcgaatttggtacagtctacaagtgcattaagaggctggatggatgtgtttatgcaataaagcgctctatgaaaacttttacagaattatcaaatgagaattcggctttgcatgaagtttatgctcacgcagtgcttgggcatcacccccatgtggtacgttactattcctcatgggcagaagatgaccacatgatcattcagaatgaatactgcaatggtgggagtttgcaagctgctatatctgaaaacactaagtctggcaatcattttgaagagccaaaactcaaggacatccttctacagatttcccttggccttaattacatccacaactctagcatggtacacctggacatcaaacctagtaatatattcatttgtcacaagatgcaaagtgaatcctctggagtcatagaagaagttgaaaatgaagctgattggtttctctctgccaatgtgatgtataaaattggtgacctgggccacgcaacatcaataaacaaacccaaagtggaagaaggagatagtcgcttcctggctaatgagattttgcaagaggattaccggcaccttcccaaagcagacatatttgccttgggattaacaattgcagtggctgcaggagcagagtcattgcccaccaatggtgctgcatggcaccatatccgcaagggtaactttccggacgttcctcaggagctctcagaaagcttttccagtctgctcaagaacatgatccaacctgatgccgaacagagaccttctgcagcagctctggccagaaatacagttctccggccttccctgggaaaaacagaagagctccaacagcagctgaatttggaaaagttcaagactgccacactggaaagggaactgagagaagcccagcaggcccagtcaccccagggatatacccatcatggtgacactggggtctctgggacccacacaggatcaagaagcacaaaacgcctggtgggaggaaagagtgcaaggtcttcaagctttacctcaggagagcgtgagcctctgcattaaaggaagaaaaggaaaacagcccttggtttggcctatggattacgaggttgctgttgctgattccccaccaaagatcccagggactcgttgtacatagaaaggaatagaatttagtttagagttgaagtcacagcttacagaaaatgtgcctggatttccacagcgcttcccaggttatatgatgctgttcctaagagagaattcccagcttctttgaggaagtgggtctcctaatgtataccctttctgatattgtatttattaaataaatggtttcaccattatgtgaggtgggtaaaagttagactgcatgcaacttggacatctctgagctggttgttaacttgcagaacaaaaatgctgtggggagaggcttcagggaaaacttgatgtgcctgtggttgttctccatctatttgccctgcctctcttgctgttctggttggtttgatattctgggtctcaccaatttctcttgatttttgtgagaatttggctttgtttcctgttttttaaaatcatattttatctaaatcctttttctgtacacatttttaaaggaagagaatactgtatttttaaataaaggtttttatcttgtccaaagcctaattacaggtaaaatatcctttgtaaaatgtaactaacaaagaatgagaaatttatgtcggagaacattttatgaataaaagggtaagagaattgagtgggtcagtagtaacaggtcttggtggcaagtctcagcttcacagttccaacagttaatgatggtcaggatctgctagaaaattatgttggtcataaaggtatttgataagctctgtttgtgtcatcttagtgaatgcaacctgttaatgataatggctttttcgctgcttgattttcttcttttcctcatttttaaaagctaattaagtttttttaattgaataaaccctaatactattcttt

SEQ ID NO: 34412 - DNA, 1557 bp, Homo sapiens
caaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagta

SEQ ID NO: 34413 - DNA, 2980 bp, Homo sapiens
gcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagtactcttcgattctgtcatggttttcctgcctggatgctaggtaccagcgttgtcaccattgcatttggtgggtggatactgggaaggagaaatcaccccagatgggaagagtggggagcttaagttaagaagtcagtgttatcttgttgaaagttaactctgatctctttaaaggaatacataaaggaattctttaaatggcttgtggaagactccagtagtcccatgcccattttttcccacttgtcctggtttcttcttgcagctccatatttctaaacagtcgtttttcttttactttatgtgtgtcctgaacacaaaatacgccactccttctgctcagttaagagttatttgtccctactgctacttcctctccctctccttagttgcatgtcgtgcatatgcccacaaggatggccccttcaggtagtcggttctcctcctgctgttgcgtgatccctcctggggtcctcctgccatgtctggaaggctgccggctgttggcctgggacgtcctctgcctttattctgagtgagatgcccattttctggatgctccatcccgccttactggtttattccgctatttcagtgcaacccatcctctagtagttttatcaggctggagggactgtatgttgcagaggcttggcccgactggcctccctccttctgtctggagtggttgcactgcagtgtgcagttgccatccccagaatctcccttcatcatcaccctggagctttcctctgcttctccctgcaccccatctgatgacaggactgactgctttctggcacaggtggcatgtaccctctagtagctttatggagcaggggtgtgtggaggaaaagtatttttagacctcaggagactcaaaatgcttttattgtaccttcagacgtgtctgagggtttggctagtaataaattgtaggtaagaaatt

SEQ ID NO: 34414 - DNA, 2595 bp, Homo sapiens
gaggcgctgccagcggccggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagta

SEQ ID NO: 34415 - DNA, 2670 bp, Homo sapiens
gaggcgctgccagcggccggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagta

SEQ ID NO: 34416 - DNA, 5215 bp, Homo sapiens
ggagctgatgtgtactgtgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcgggttttctttcagatattgttttgtatttacccatgaagacattgttttttggactctgcaaataggacatttcaaagatgagtgaaaaaaaattggaaacaactgcacagcagcggaaatgtcctgaatggatgaatgtgcagaataaaagatgtgctgtagaagaaagaaaggcatgtgttcggaagagtgtttttgaagatgacctccccttcttagaattcactggatccattgtgtatagttacgatgctagtgattgctctttcctgtcagaagatattagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaagctgaaatgcacagagacctggagccttaacagtctggttaaacacctcttaggtaaacagctcctgaaagacaagtctatccgctgtagcaattggagtaaatttcctctcactgaggaccagaaactgtatgcagccactgatgcttatgctggttttattatttaccgaaatttagagattttggatgatactgtgcaaaggtttgctataaataaagaggaagaaatcctacttagcgacatgaacaaacagttgacttcaatctctgaggaagtgatggatctggctaagcatcttcctcatgctttcagtaaattggaaaacccacggagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgagcatttatctcccaatgataatgaaaacgatacgtcctatgtaattgagagtgatgaagatttagaaatggagatgcttaagcatttatctcccaatgataatgaaaacgatacgtcctatgtaattgagagtgatgaagatttagaaatggagatgcttaagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataaggactttttgtggccagcacccaatgaagagcaagttacttgcctcaagatgtactttggccattccagttttaaaccagttcagtggaaagtgattcattcagtattagaagaaagaagagataatgttgctgtcatggcaactggatatggaaagagtttgtgcttccagtatccacctgtttatgtaggcaagattggccttgttatctctccccttatttctctgatggaagaccaagtgctacagcttaaaatgtccaacatcccagcttgcttccttggatcagcacagtcagaaaatgttctaacagatattaaattaggtaaataccggattgtatacgtaactccagaatactgttcaggtaacatgggcctgctccagcaacttgaggctgatattggtatcacgctcattgctgtggatgaggctcactgtatttctgagtgggggcatgattttagggattcattcaggaagttgggctccctaaagacagcactgccaatggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaagttcccactgggaatttgaaggtccaacaatcatctactgtccttctagaaaaatgacacaacaagttacaggtgaacttaggaaactgaatctatcctgtggaacataccatgcgggcatgagttttagcacaaggaaagacattcatcataggtttgtaagagatgaaattcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggcaccttcttactgagatacgtaatgagaagtttcgattatacaaattaaagatgatggcaaagatggaaaaatatcttcattctagcagatgtaggagacaaatcatcttgtctcattttgaggacaaacaagtacaaaaagcctccttgggaattatgggaactgaaaaatgctgtgataattgcaggtccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagttgcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattatatatata

SEQ ID NO: 34417 - DNA, 941 bp, Homo sapiens
gccccgagtcctgttgcccacacgcccgaggcgcgctggattggcggagcatggcccaggaggagggtgggagcctgcccgaggtgcgggcgcgggtcagggccgcgcatggcatccccgacctggcccaaaagctccatttctatgaccgctgggctccggactacgaccaggatgtggccaccctgctgtaccgtgcgccccgcctcgcagtggactgcctcacacaagcccttccaggcccgccccacagtgccctgatcctggacgtggcctgtggcacaggcctagtggctgccgagctgcgggctccaggcttcctccagctgcatggggtggatgggagcccagggatgctggaacaggcccaggcccccggcctctatcagcgcctcagcctctgcaccctgggccaggagcctctgcccagcccggaagggaccttcgacgcggtgctgatagtcggtgccctcagtgacggccaggtgccctgcaatgcgatacctgagctacatgtcaccaagccaggtgggctggtgtgtctgaccaccaggaccaactcgtccaaccttcaatacaaggaggctctggaggccaccctggacaggctggagcaggctgggatgtgggaaggcctggtggcctggcctgtggaccgcctgtggaccgctgggagctggctacctccgagctggaggtggtatccggcatctctgccaaggatggcttcatctccggcattgtctacctgtaccgaaagtggaaggcgacccaggttgaggaagtgagatccagcccccagcccccagctggcccctgactccatgtggccttagctgggcccatctgctgggcctcctctgcctcccctgtaaaatgggacctccgaaccaaccctgcccctcagaaatgccctgcctattaaatgagctcccagaaaa

SEQ ID NO: 34418 - DNA, 854 bp, Homo sapiens
gcttctcccagctggagtaggtgggggaggccagacatggaggcccttcctccagtcagatccagccttttggggatcctgttgcaggttacgaggctctcagtgctgttggttcagaaccgagatcacctctataatttcctgctcctcaagatcaacctcttcaaccactgggtgtcagggctggcccaggaggcccgggggtcctgtaactggcaggcccacctacccctgggagctgcagcctgccccctgggccaggctctctgggctgggctggctctgatacaggtccccgtatggctggtgctacagggacccaggctgatgtgggctggcatgtggggcagcaccaagggcctgggcctggccttgctcagtgcctgggagcagctgggcctgtctgtggccatctggacagatctgtttttgtcatgtctgcacggcctgatgttggtggccttgctcttggtggtagtgacctggagggtgtgtcagaagtcccactgcttccgactgggcaggcagctcagtaaggccttgcaagtgaactgcgtggtaaggaagctcctggtacagctgagacgtctgtattggtgggtggagactatgactgccctcacctcctggcacctggcctatctcatcacctggaccacctgcctggcctcccacctgctgcaggctgcctttgagcacacgacccagctggccgaggcccaggaggttgaaccccaggaggtctcagggtcttccttgctgccctcactgtctgcgtcctcggactcagagtctggaacagttttgccagagcaagaaactcccagagaataaatgtatccccatctgcctct

SEQ ID NO: 34419 - DNA, 1622 bp, Homo sapiens
ggccggcggcagagctgtccggctgcgcggtggcccggggggcccgggcggcagggcaagcagcgcggcctcggcctatgcgaccggtggcgccggcgcggcttctgcctggagaggattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgcctt

SEQ ID NO: 34420 - DNA, 3656 bp, Homo sapiens
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatgaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttttttcttttctttttttttttttttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaa

SEQ ID NO: 34421 - DNA, 2907 bp, Homo sapiens
agcagagcggacggggcgcgcgggaggcgcgcagagctttcgggctgcaggcgctcgctgcgcctggggaattgggctgtgggcgaggcggtccgggctggcctttatcgctcgctgggcccatcgtttgaaactttatcagcgagtctcgccactcgtcgcagacgcgagcggggggcgggggcgcggcgaggcgccggcggccgtgacgaggcgctcccggagctgagcgcttctgctctgggcacgcatggcgcccgcacacggagtctgacctgatgcagacgcaagggggttaatatgaacgcccctctcggtggaatctggctctggctccctctgctcttgacctggctcacccccgaggtcaactcttcatggtggtacatgagagctacaggtggctcctccagggtgatgtgcgataatgtgccaggcctggtgagcagccagcggcagctgtgtcaccgacatccagatgtgatgcgtgccattagccagggcgtggccgagtggacagcagaatgccagcaccagttccgccagcaccgctggaattgcaacaccctggacagggatcacagcctttttggcagggtcctactccgaagtagtcgggaatctgcctttgtttatgccatctcctcagctggagttgtatttgccatcaccagggcctgtagccaaggagaagtaaaatcctgttcctgtgatccaaagaagatgggaagcgccaaggacagcaaaggcatttttgattggggtggctgcagtgataacattgactatgggatcaaatttgcccgcgcatttgtggatgcaaaggaaaggaaaggaaaggatgccagagccctgatgaatcttcacaacaacagagctggcaggaaggctgtaaagcggttcttgaaacaagagtgcaagtgccacggggtgagcggctcatgtactctcaggacatgctggctggccatggccgacttcaggaaaacgggcgattatctctggaggaagtacaatggggccatccaggtggtcatgaaccaggatggcacaggtttcactgtggctaacgagaggtttaagaagccaacgaaaaatgacctcgtgtattttgagaattctccagactactgtatcagggaccgagaggcaggctccctgggtacagcaggccgtgtgtgcaacctgacttcccggggcatggacagctgtgaagtcatgtgctgtgggagaggctacgacacctcccatgtcacccggatgaccaagtgtgggtgtaagttccactggtgctgcgccgtgcgctgtcaggactgcctggaagctctggatgtgcacacatgcaaggcccccaagaacgctgactggacaaccgctacatgaccccagcaggcgtcaccatccaccttcccttctacaaggactccattggatctgcaagaacactggacctttgggttctttctggggggatatttcctaaggcatgtggcctttatctcaacggaagccccctcttcctccctgggggccccaggatgggggggccacacgctgcacctaaagcctaccctattctatccatctcctggtgttctgcagtcatctcccctcctggcgagttctctttggaaatagcatgacaggctgttcagccgggagggtggtgggcccagaccactgtctccacccaccttgacgtttcttctttctagagcagttggccaagcagaaaaaaaagtgtctcaaaggagctttctcaatgtcttcccacaaatggtcccaattaagaaattccatacttctctcagatgggaacagtaaagaaagcagaatcaactgcccctgacttaactttaacttttgaaaagaccaagacttttgtctgatcaagtggttttacagctaccacccttaggggtaattggtaattacctggagaagaatggctttcaatacccttttaagtttaaaatgtgtatttttcaaggcatttattgccatattaaaatctgatgtaacaaggtggggacgtgtgtcctttggtactatggtgtgttgtatctttgtaagagcaaaagcctcagaaagggattgctttgcattactgtccccttgatataaaaaatctttagggaatgagagttccttctcacttagaatccgaagggaattaaaaagaagatgaatggtctggcaatattctgtaactattgggtgaatatggtggaaaataatttagtggatggaatatcagaagtatatctgtacagatcaagaaaaaaagggagaataaaattcctatctcatattatgcatgtgacccatggaatctcataactgaaagacttgaaggatgaaaattttggggatacaagattggtgaactaaaatgctgacagagaggtttccagagctaactcgtgcctggggcggccttacaataagcagatgcctgaaagaagtcggccacgtccgccgtctgctaatgcccatcacccttcaagcccagtttaaagacctgtcatatttaattgtatttatttgatgcttacaagatgatgtgatactgtagcctaaagcaaatgacacatagcattgcttataaagttggtaaccctgctatattatattgcaaacaaatcgtaacttggagactatgtttaagggactcaactgtaattatgggagcatcagtatgcaaatagtggttggcttctgccatcagccaaaagatgacattcagggaaaatggagaggctgcctgcaccgtttttttatgttaaatgaaagaaaggtgaaatagctacttctcgtcttcttgaaaaatttggttcttattctgtatatgacttccttacagtgctacattaacaggatatttcattacatgcatctggtatcaaa

SEQ ID NO: 34422 - DNA, 1185 bp, Homo sapiens
caactgcagcacagagcgggcaaagccaggcaggccatggggctctgggcgctgttgcctggctgggtttctgctacgctgctgctggcgctggccgctctgcccgcagccctggctgccaacagcagtggccgatggtggggtattgtgaacgtagcctcctccacgaacctgcttacagactccaagagtctgcaactggtactcgagcccagtctgcagctgttgagccgcaaacagcggcgtctgatacgccaaaatccggggatcctgcacagcgtgagtggggggctgcagagtgccgtgcgcgagtgcaagtggcagttccggaatcgccgctggaactgtcccactgctccagggccccacctcttcggcaagatcgtcaaccgaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcgggacctgcgcttcctcatgaaccttcacaacaacgaggcaggccgtacgaccgtattctccgagatgcgccaggagtgcaagtgccacgggatgtccggctcatgcacggtgcgcacgtgctggatgcggctgcccacgctgcgcgccgtgggcgatgtgctgcgcgaccgcttcgacggcgcctcgcgcgtcctgtacggcaaccgcggcagcaaccgcgcttcgcgggcggagctgctgcgcctggagccggaagacccggcccacaaaccgccctccccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtgaggcgctgcgcggactcgcccccaggaacgctctcct

SEQ ID NO: 34423 - DNA, 588 bp, Homo sapiens
tggcactgggggggctgcagcgacaacattgacttcggccgcctcttcggccgggagttcgtggactccggggagaaggggcgggacctgcgcttcctcatgaaccttcacaacaacgaggcaggccgtacgaccgtattctccgagatgcgccaggagtgcaagtgccacgggatgtccggctcatgcacggtgcgcacgtgctggatgcggctgcccacgctgcgcgccgtgggcgatgtgctgcgcgaccgcttcgacggcgcctcgcgcgtcctgtacggcaaccgcggcagcaaccgcgcttcgcgggcggagctgctgcgcctggagcccgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtga

SEQ ID NO: 34424 - DNA, 2547 bp, Homo sapiens
cctcagcagggacgctcccacccccagtccccagcggacgcagtggcctcgggactcgtacacgcctccacgccccgccgcgtgacgtcacgtggggtagagccctgagacactaaatggcgggggggtggggggaggaaagggaaggcggcagagctccccgagccgggacagtcacttactctacaggcagtggggcccgacacagacagcgccgcccccgccagccagcctcgcacgccctcggaagcgcaggctcccggcgctgcgctggagggttccccggcaccccagcctcccgtccccagcccgctgcacctccgggccccccttacccttgagaggcaccgggagttgtcgcgggggggcctcgggaaattccccggacccctgtgccaggaggtgcccggttcgcccgctcttcaccccccgccccccccgagggcggtgcccgggggtgctgccccatggagcggggaggcgggcgccgtctgctccgggagccctgacccgagtcggagctgtgtgtcgcagccgccccgaccccccgccgatcatgcgccggcgcccctggctctccagtcccactgggctgtgagccccccactcccagcccgtcagggcctgcgcgccatgggcagcgcccaccctcgcccctggctgcggctccgaccccagccccagccgcggccagcgctctgggtgctcctgttcttcctactgctgctggctgctgccatgcccaggtcagcacccaatgacattctggacctccgcctccccccggagcccgtgctcaatgccaacacagtgtgcctaacattgccaggcctgagccggcggcagatggaggtgtgtgtgcgtcaccctgatgtggctgcctcagccatacagggcatccagatcgccatccacgaatgccaacaccaattcagggaccagcgctggaactgctcaagcctggagactcgcaacaagatcccctatgagagtcccatcttcagcagaggtttccgagagagcgcttttgcctacgccatcgcagcagctggcgtggtgcacgccgtgtccaatgcgtgtgccctgggcaaactgaaggcctgtggctgtgatgcgtcccggcgaggggacgaggaggccttccgtaggaagctgcaccgcttacaactggatgcactgcagcgtggtaagggcctgagccatggggtcccggaacacccagccctgcccacagccagcccaggcctgcaggactcctgggagtggggcggctgcagccccgacatgggcttcggggagcgcttttctaaggactttctggactcccgggagcctcacagagacatccacgcgagaatgaggcttcacaacaaccgagttgggaggcaggcagtgatggagaacatgcggcggaagtgcaagtgccacggcacgtcaggcagctgccagctcaagacgtgctggcaggtgacgcccgagttccgcaccgtgggggcgctgctgcgcagccgcttccaccgcgccacgctcatccggccgcacaaccgcaacggcggccagctggagccgggcccagcgggggcaccctcgccggctccgggcgctcccgggccgcgccgacgggccagccccgccgacctggtctacttcgaaaagtctcccgacttctgcgagcgcgagccgcgcctggactcggcgggcaccgtgggccgcctgtgcaacaagagcagcgccggctcggatggctgcggcagcatgtgctgcggccgcggccacaacatcctgcgccagacgcgcagcgagcgctgccactgccgcttccactggtgctgtttcgtggtctgcgaagagtgccgcatcaccgagtgggtcagcgtctgcaagtgagcggcccggggtcccctgggccctgatcgaggtcccctcctggagcctggccctctgaggcttacggtcttggcaaggcagcatcgccttggctcttgggaagaggagattggaccacatgatcttataggaacccctcagctctgaggtctgtgatcgccggacagtccaggcctgtctgaaccccaccactcacttctgtgggctctaggactgactgggttcttcctccctccccgaagcccagacagttcagttgggctgggggttgctccacaccctaaaacaagcctcagccaggcaacccgtcagtctgtctccatcctttcaccccttccctggagatgggaggtggggaatgaatggaagctgacgggcagagagaggaggattaaaaaaaagaaatagacataactgagctgaagtaattccataaagggcccagacagcctcctccaccattcccttcatcattcatttaacaaatatttattttgcactctctttgcggcactctgggggcggtggggtgcgtgggggtggcaatgcaaggcactgaggccacagatgtgagtaagcgagacacaacacttgtcctcttggaggttacattcttgctggggggaggcatgggcaataaacaagtaaatatacaaacaa

SEQ ID NO: 34425 - DNA, 2274 bp, Homo sapiens
ggaggggctgcagctccgtcagcccggcagagccaccctgagctcggtgagagcaaagccagagcccccagtcctttgctcgccggcttgctagctctctcgatcactccctcccttcctccctcccttcctcccggcggccgcggcggcgctggggaagcggtgaagaggagtggcccggccctggaagaatgcggctctgacaaggggacagaacccagcgcagtctccccacggtttaagcagcactagtgaagcccaggcaacccaaccgtgcctgtctcggaccccgcacccaaaccactggaggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtttccgagaaagtgctttttccttctccatgctggctgctggggtcatgcacgcagtagccacggcctgcagcctgggcaagctggtgagctgtggctgtggctggaagggcagtggtgagcaggatcggctgagggccaaactgctgcagctgcaggcactgtcccgaggcaagagtttcccccactctctgcccagccctggccctggctcaagccccagccctggcccccaggacacatgggaatggggtggctgtaaccatgacatggactttggagagaagttctctcgggatttcttggattccagggaagctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcggctgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcagccttaccttggggctggggaagaggactgtgtgagaggggcgccttttcagccctttgctctgatttccttccaaggtcactcttggtccctggaagcttaaagtatctacctggaaacagctttaggggtggtgggggtcaggtggactctgggatgtgtagccttctccccaacaattggagggtcttgaggggaagctgccacccctcttctgctccttagacacctgaatggactaagatgaaatgcactgtattgctcctcccacttctcaactccagagcccctttaaccctgattcatactccttttggctggggagtccctatagtttcaccactcctctcccttgagggataaccccaggcactgtttggagccataagatctgtatctagaaagagatcacccactcctatgtactatccccaaactcctttactgcagcctgggctccctcttgtgggataatgggagacagtggtagagaggtttttcttgggaaagagacagagtgctgaggggcactctcccctgaatcctcagagagttgtctgtccaggcccttagggaagttgtctccttccattcagatgttaatggggaccctccaaaggaaggggttttcccatgactcttggagcctctttttccttcttcagcaggaagggtgggaagggataatttatcatactgagacttgttcttggttcctgtttgaaactaaaataaattaagttactgga

SEQ ID NO: 34426 - DNA, 1802 bp, Homo sapiens
acccaaccgtgcctgtctcggaccccgcacccaaaccactggaggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtttccgagaaagtgctttttccttctccatgctggctgctggggtcatgcacgcagtagccacggcctgcagcctgggcaagctggtgagctgtggctgtggctggaagggcagtggtgagcaggatcggctgagggccaaactgctgcagctgcaggcactgtcccgagggaagctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcggctgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcagccttaccttggggctggggaagaggactgtgtgagaggggcgccttttcagccctttgctctgatttccttccaaggtcactcttggtccctggaagcttaaagtatctacctggaaacagctttaggggtggtgggggtcaggtggactctgggatgtgtagccttctccccaacaattggagggtcttgaggggaagctgccacccctcttctgctccttagacacctgaatggactaagatgaaatgcactgtattgctcctcccacttctcaactccagagcccctttaaccctgattcatactccttttggctggggagtccctatagtttcaccactcctctcccttgagggataaccccaggcactgtttggagccataagatctgtatctagaaagagatcacccactcctatgtactatccccaaactcctttactgcagcctgggctccctcttgtgggataatgggagacagtggtagagaggtttttcttgggaaagagacagagtgctgaggggcactctcccctgaatcctcagagagttgtctgtccaggcccttagggaagttgtctccttccattcagatgttaatggggaccctccaaaggaaggggttttcccatgactcttggagcctctttttccttcttcagcaggaagggtgggaaggga

SEQ ID NO: 34427 - DNA, 559 bp, Homo sapiens
caagtgtttgtgagtctgtgtgtctgagtttgcaagtgagtgtgtgtctgtgtgccgggcgttgtgtctgattgggcaaggttccaggggtgctcgcttgagtcctgagctgggacaacgccttgactcttcttctttaagacctccaagcctcagggactctgggaatcaaggggtgtttcttcttgttttgtttgaggaggaatgagaagggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgc

SEQ ID NO: 34428 - DNA, 1489 bp, Homo sapiens
gcgcttctgacaagcccgaaagtcatttccaatctcaagtggactttgttccaactattgggggcgtcgctccccctcttcatggtcgcgggcaaacttcctcctcggcgcctcttctaatggagccccacctgctcgggctgctcctcggcctcctgctcggtggcaccagggtcctcgctggctacccaatttggtggtccctggccctgggccagcagtacacatctctgggctcacagcccctgctctgcggctccatcccaggcctggtccccaagcaactgcgcttctgccgcaattacatcgagatcatgcccagcgtggccgagggcgtgaagctgggcatccaggagtgccagcaccagttccggggccgccgctggaactgcaccaccatagatgacagcctggccatctttgggcccgtcctcgacaaagccacccgcgagtcggccttcgttcacgccatcgcctcggccggcgtggccttcgccgtcacccgctcctgcgccgagggcacctccaccatttgcggctgtgactcgcatcataaggggccgcctggcgaaggctggaagtggggcggctgcagcgaggacgctgacttcggcgtgttagtgtccagggagttcgcggatgcgcgcgagaacaggccggacgcgcgctcggccatgaacaagcacaacaacgaggcgggccgcacgactatcctggaccacatgcacctcaaatgcaagtgccacgggctgtcgggcagctgtgaggtgaagacctgctggtgggcgcagcctgacttccgtgccatcggtgacttcctcaaggacaagtatgacagcgcctcggagatggtagtagagaagcaccgtgagtcccgaggctgggtggagaccctccgggccaagtactcgctcttcaagccacccacggagagggacctggtctactacgagaactcccccaacttttgtgagcccaacccagagacgggttcctttggcacaagggaccggacttgcaatgtcacctcccacggcatcgatggctgcgatctgctctgctgtggccggggccacaacacgaggacggagaagcggaaggaaaaatgccactgcatcttccactggtgctgctacgtcagctgccaggagtgtattcgcatctacgacgtgcacacctgcaagtagggcaccagggcgctgggaaggggtgaagtgtgtggctgggcggattcagcgaagtctcatgggaagcaggacctagagccgggcacagccctcagcgtcagacagcaaggaactgtcaccagccgcacgcgtggtaaatgacccagacccaactcgcctgtggacggggaggctctccctctctctcatcttacatttctcaccctactctggatggtgtgtggtttttaaagaagggggctttctttttagttctctagggtctgataggaacagacctgaggcttatctttgcacatgtt

SEQ ID NO: 34429 - DNA, 2932 bp, Homo sapiens
agctcccagggcccggccccccccggcgctcacgctctcggggcggactcccggccctccgcgccctctcgcgcggcgatggccccactcggatacttcttactcctctgcagcctgaagcaggctctgggcagctacccgatctggtggtcgctggctgttgggccacagtattcctccctgggctcgcagcccatcctgtgtgccagcatcccgggcctggtccccaagcagctccgcttctgcaggaactacgtggagatcatgcccagcgtggccgagggcatcaagattggcatccaggagtgccagcaccagttccgcggccgccggtggaactgcaccaccgtccacgacagcctggccatcttcgggcccgtgctggacaaagctaccagggagtcggcctttgtccacgccattgcctcagccggtgtggcctttgcagtgacacgctcatgtgcagaaggcacggccgccatctgtggctgcagcagccgccaccagggctcaccaggcaagggctggaagtggggtggctgtagcgaggacatcgagtttggtgggatggtgtctcgggagttcgccgacgcccgggagaaccggccagatgcccgctcagccatgaaccgccacaacaacgaggctgggcgccaggccatcgccagccacatgcacctcaagtgcaagtgccacgggctgtcgggcagctgcgaggtgaagacatgctggtggtcgcaacccgacttccgcgccatcggtgacttcctcaaggacaagtacgacagcgcctcggagatggtggtggagaagcaccgggagtcccgcggctgggtggagaccctgcggccgcgctacacctacttcaaggtgcccacggagcgcgacctggtctactacgaggcctcgcccaacttctgcgagcccaaccctgagacgggctccttcggcacgcgcgaccgcacctgcaacgtcagctcgcacggcatcgacggctgcgacctgctgtgctgcggccgcggccacaacgcgcgagcggagcggcgccgggagaagtgccgctgcgtgttccactggtgctgctacgtcagctgccaggagtgcacgcgcgtctacgacgtgcacacctgcaagtaggcaccggccgcggctccccctggacggggcgggccctgcctgagggtgggcttttccctgggtggagcaggactcccacctaaacggggcagtactcctccctgggggcgggactcctccctgggggtggggctcctacctgggggcagaactcctacctgaaggcagggctcctccctggagctagtgtctcctctctggtggctgggctgctcctgaatgaggcggagctccaggatggggaggggctctgcgttggcttctccctggggacggggctcccctggacagaggcggggctacagattgggcggggcttctcttgggtgggacagggcttctcctgcgggggcgaggcccctcccagtaagggcgtggctctgggtgggcggggcactaggtaggcttctacctgcaggcggggctcctcctgaaggaggcggggctctaggatggggcacggctctggggtaggctgctccctgagggcggagcgcctccttaggagtggggttttatggtggatgaggcttcttcctggatggggcagagcttctcctgaccagggcaaggccccttccacgggggctgtggctctgggtgggcgtggcctgcataggctccttcctgtgggtggggcttctctgggaccaggctccaatggggcggggcttctctccgcgggtgggactcttccctgggaaccgccctcctgattaaggcgtggcttctgcaggaatcccggctccagagcaggaaattcagcccaccagccacctcatccccaaccccctgtaaggttccatccacccctgcgtcgagctgggaaggttccatgaagcgagtcgggtccccaacccgtgcccctgggatccgagggcccctctccaagcgcctggctttggaatgctccaggcgcgccgacgcctgtgccaccccttcctcagcctggggtttgaccacccacctgaccaggggccctacctggggaaagcctgaagggcctcccagcccccaaccccaagaccaagcttagtcctgggagaggacagggacttcgcagaggcaagcgaccgaggccctcccaaagaggcccgccctgcccgggctcccacaccgtcaggtactcctgccagggaactggcctgctgcgccccaggccccgcccgtctctgctctgctcagctgcgcccccttctttgcagctgcccagcccctcctccctgccctcgggtctccccacctgcactccatccagctacaggagagatagaagcctctcgtcccgtccctccctttcctccgcctgtccacagccccttaagggaaaggtaggaagagaggtccagccccccaggctgcccagagctgctggtctcatttgggggcgttcgggaggtttggggggcatcaaccccccgactgtgctgctcgcgaaggtcccacagccctgagatgggccggcccccttcctggcccctcatggcgggactggagaaatggtccgctttcctggagccaatggcccggcccctcctgactcatccgcctggcccgggaatgaatggggaggccgctgaacccacccggcccatatccctggttgcctcatggccagcgcccctcagcctctgccactgtgaaccggctcccaccctcaaggtgcggggagaagaagcggccaggcggggcgccccaagagcccaaaagagggcacaccgccatcctctgcctcaaattctgcgtttttggttttaatgttatatctgatgctgctatatccactgtccaacgg

SEQ ID NO: 34430 - DNA, 1368 bp, Homo sapiens
acgctctcggggcggactcccggccctccgcgccctctcgcgcggcgatggccccactcggatacttcttactcctctgcagcctgaagcaggctctgggcagctacccgatctggtggtcgctggctgttgggccacagtattcctccctgggctcgcagcccatcctgtgtgccagcatcccgggcctggtccccaagcagctccgcttctgcaggaactacgtggagatcatgcccagcgtggccgagggcatcaagattggcatccaggagtgccagcaccagttccgcggccgccggtggaactgcaccaccgtccacgacagcctggccatcttcgggcccgtgctggacaaagctaccagggagtcggcctttgtccacgccattgcctcagccggtgtggcctttgcagtgacacgctcatgtgcagaaggcacggccgccatctgtggctgcagcagccgccaccagggctcaccaggcaagggctggaagtggggtggctgtagcgaggacatcgagtttggtgggatggtgtctcgggagttcgccgacgcccgggagaaccggccagatgcccgctcagccatgaaccgccacaacaacgaggctgggcgccaggccatcgccagccacatgcacctcaagtgcaagtgccacgggctgtcgggcagctgcgaggtgaagacatgctggtggtcgcaacccgacttccgcgccatcggtgacttcctcaaggacaagtacgacagcgcctcggagatggtggtggagaagcaccgggagtcccgcggctgggtggagaccctgcggccgcgctacacctacttcaaggtgcccacggagcgcgacctggtctactacgaggcctcgcccaacttctgcgagcccaaccctgagacgggctccttcggcacgcgcgaccgcacctgcaacgtcagctcgcacggcatcgacggctgcgacctgctgtgctgcggccgcggccacaacgcgcgagcggagcggcgccgggagaagtgccgctgcgtgttccactggtgctgctacgtcagctgccaggagtgcacgcgcgtctacgacgtgcacacctgcaagaatcccggctccagagcaggaaattcagcccaccagccacctcatccccaaccccctgtaaggttccatccacccctgcgtcgagctgggaaggttccatgaagcgagtcgggtccccaacccgtgcccctgggatccgagggcccctctccaagcgcctggctttggaatgctccaggcgcgccgacgcctgtgccaccccttcctcagcctggggtttgaccacccacctgaccaggggccctacctggggaaagcctgaagg

SEQ ID NO: 34431 - DNA, 1182 bp, Homo sapiens
gcggccgcagccgctgccccgggccgggcgcccgcggcggcaccatgagtccccgctcgtgcctgcgttcgctgcgcctcctcgtcttcgccgtcttctcagccgccgcgagcaactggctgtacctggccaagctgtcgtcggtggggagcatctcagaggaggagacgtgcgagaaactcaagggcctgatccagaggcaggtgcagatgtgcaagcggaacctggaagtcatggactcggtgcgccgcggtgcccagctggccattgaggagtgccagtaccagttccggaaccggcgctggaactgctccacactcgactccttgcccgtcttcggcaaggtggtgacgcaagggactcgggaggcggccttcgtgtacgccatctcttcggcaggtgtggcctttgcagtgacgcgggcgtgcagcagtggggagctggagaagtgcggctgtgacaggacagtgcatggggtcagcccacagggcttccagtggtcaggatgctctgacaacatcgcctacggtgtggccttctcacagtcgtttgtggatgtgcgggagagaagcaagggggcctcgtccagcagagccctcatgaacctccacaacaatgaggccggcaggaaggccatcctgacacacatgcgggtggaatgcaagtgccacggggtgtcaggctcctgtgaggtaaagacgtgctggcgagccgtgccgcccttccgccaggtgggtcacgcactgaaggagaagtttgatggtgccactgaggtggagccacgccgcgtgggctcctccagggcactggtgccacgcaacgcacagttcaagccgcacacagatgaggacctggtgtacttggagcctagccccgacttctgtgagcaggacatgcgcagcggcgtgctgggcacgaggggccgcacatgcaacaagacgtccaaggccatcgacggctgtgagctgctgtgctgtggccgcggcttccacacggcgcaggtggagctggctgaacgctgcagctgcaaattccactggtgctgcttcgtcaagtgccggcagtgccagcggctcgtggagttgcacacgtgccgatgaccgcctgcctagccctgcgccggcaaccacctagtggcccagggaaggccgataatttaaacagtctcccaccacctacccc

SEQ ID NO: 34432 - DNA, 632 bp, Homo sapiens
gccgcgcgcgccccggcccgcccgcgggcgcccacctgcagccccgacgggaggccccccgcggccgcagccgctgccccgggccgggcgcccgcggcggcaccatgagtccccgctcgtgcctgcgttcgctgcgcctcctcgtcttcgccgtcttctcagccgccgcgagcaactggctgtacctggccaagctgtcgtcggtggggagcatctcagaggaggagacgtgcgagaaactcaagggcctgatccagaggcaggtgcagatgtgcaagcggaacctggaagtcatggactcggtgcgccgcggtgcccagctggccattgaggagtgccagtaccagttccggaaccggcgctggaactgctccacactcgactccttgcccgtcttcggcaaggtggtgacgcaaggtggcaaagcctggcatggaggagacagtggatgtcatctactgacagaaagcaggtcaggggagaggactcaaaggcgcaaggaaggaggtagcctggggcaatgctggcctgaagccatcgtgggtactcaggaccccatgagaagccctccttacctttgggggaggaaccaagggggcacccacaccggctcagcatctgagggacactga

SEQ ID NO: 34433 - DNA, 680 bp, Homo sapiens
gtacctggccaagctgtcgtcggtggggagcatctcagaggaggagacgtgcgagaaactcaagggcctgatccagaggcaggtgcagatgtgcaagcggaacctggaagtcatggactcggtgcgccgcggtgcccagctggccattgaggagtgccagtaccagttccggaaccggcgctggaactgctccacactcgactccttgcccgtcttcggcaaggtggtgacgcaaggtggcaaagcctggcatggaggagacagtggatgtcatctactgacagaaagcaggtcaggggagaggactcaaaggcgcaaggaaggaggtagcctggggcaatgctggcctgaagccatcgtgggtactcaggaccccatgagaagccctccttacctttgggggaggaaccaagggggcacccacaccggctcagcatctgagggacactgagattcctactaggcctgggtggtacctgctctggactaaagtctgactggtggagtcgaacgtccaatcccctttggagagggacatgtcaaggtgccgagactaagccagtcacactcggcaggtgccagtcacacctggagaaggaggctgagctctgcccactcatcaaactcctcccttttacgtttttggttttcttccctagtaaaattcctcttggaaactt

SEQ ID NO: 34434 - DNA, 482 bp, Homo sapiens
tggtgagtgagccaagagagcttccctaaactcctcctgtcctcccaatcacagcgtcttaagcccacttcccggatgagaaaacggaggctcagagtcaagaccctgctgcctggggcgcgcccagaccttgtggctagccagaagcgaggtttcggattcccacagtctcgggccactgtcccaagctgcccaaagctggggaggccccgtccagctcccggaaggctgtagggaggtacctggccaagctgtcgtcggtggggagcatctcagaggaggagacgtgcgagaaactcaagggcctgatccagaggcaggtgcagatgtgcaagcggaacctggaagtcatggactcggtgcgccgcggtgcccagctggccattgaggagtgccagtaccagttccggaaccggcgctggaactgctccacactcgactccttgcccgtcttcggcaaggtggtgacgcaaggtggcaaa

SEQ ID NO: 34435 - DNA, 1162 bp, Homo sapiens
gagaaaacggaggctcagagtcaagaccctgctgcctggggcgcgcccagaccttgtggctagccagaagcgaggtttcggattcccacagtctcgggccactgtcccaagctgcccaaagctggggaggccccgtccagctcccggaaggctgtagggaggtacctggccaagctgtcgtcggtggggagcatctcagaggaggagacgtgcgagaaactcaagggcctgatccagaggcaggtgcagatgtgcaagcggaacctggaagtcatggactcggtgcgccgcggtgcccagctggccattgaggagtgccagtaccagttccggaaccggcgctggaactgctccacactcgactccttgcccgtcttcggcaaggtggtgacgcaagggactcgggaggcggccttcgtgtacgccatctcttcggcaggtgtggcctttgcagtgacgcgggcgtgcagcagtggggagctggagaagtgcggctgtgacaggacagtgcatggggtcagcccacagggcttccagtggtcaggatgctctgacaacatcgcctacggtgtggccttctcacagtcgtttgtggatgtgcgggagagaagcaagggggcctcgtccagcagagccctcatgaacctccacaacaatgaggccggcaggaaggccatcctgacacacatgcgggtggaatgcaagtgccacggggtgtcaggctcctgtgaggtaaagacgtgctggcgagccgtgccgcccttccgccaggtgggtcacgcactgaaggagaagtttgatggtgccactgaggtggagccacgccgcgtgggctcctccagggcactggtgccacgcaacgcacagttcaagccgcacacagatgaggacctggtgtacttggagcctagccccgacttctgtgagcaggacatgcgcagcggcgtgctgggcacgaggggccgcacatgcaacaagacgtccaaggccatcgacggctgtgagctgctgtgctgtggccgcggcttccacacggcgcaggtggagctggctgaacgctgcagctgcaaattccactggtgctgcttcgtcaagtgccggcagtgccagcggctcgtggagttgcacacgtgccgatgaccgcctgcctagccctgcgccg

SEQ ID NO: 34436 - DNA, 1703 bp, Homo sapiens
tccgcaggagacacaggcgctggctgccccgtccgctctccgcctccgccgcgccctcctcgcccgggatgggcccccccgccgccgccggatccctcgcctcccggccgccgccgttgcgctcgccgcgctcgcactgaagcccgggccctcgcgcgccgcggttcgccccgcagcctcgccccctgcccacccgggcggccgtagggcggtcacgatgctgccgcccttaccctcccgcctcgggctgctgctgctgctgctcctgtgcccggcgcacgtcggcggactgtggtgggctgtgggcagccccttggttatggaccctaccagcatctgcaggaaggcacggcggctggccgggcggcaggccgagttgtgccaggctgagccggaagtggtggcagagctagctcggggcgcccggctcggggtgcgagagtgccagttccagttccgcttccgccgctggaattgctccagccacagcaaggcctttggacgcatcctgcaacaggacattcgggagacggccttcgtgttcgccatcactgcggccggcgccagccacgccgtcacgcaggcctgttctatgggcgagctgctgcagtgcggctgccaggcgccccgcgggcgggcccctccccggccctccggcctgcccggcacccccggaccccctggccccgcgggctccccggaaggcagcgccgcctgggagtggggaggctgcggcgacgacgtggacttcggggacgagaagtcgaggctctttatggacgcgcggcacaagcggggacgcggagacatccgcgcgttggtgcaactgcacaacaacgaggcgggcaggctggccgtgcggagccacacgcgcaccgagtgcaaatgccacgggctgtcgggatcatgcgcgctgcgcacctgctggcagaagctgcctccatttcgcgaggtgggcgcgcggctgctggagcgcttccacggcgcctcacgcgtcatgggcaccaacgacggcaaggccctgctgcccgccgtccgcacgctcaagccgccgggccgagcggacctcctctacgccgccgattcgcccgacttctgcgcccccaaccgacgcaccggctcccccggcacgcgcggtcgcgcctgcaatagcagcgccccggacctcagcggctgcgacctgctgtgctgcggccgcgggcaccgccaggagagcgtgcagctcgaagagaactgcctgtgccgcttccactggtgctgcgtagtacagtgccaccgctgccgtgtgcgcaaggagctcagcctctgcctgtgacccgccgcccggccgctagactgacttcgcgcagcggtggctcgcacctgtgggacctcagggcaccggcaccgggcgcctctcgccgctcgagcccagcctctccctgccaaagcccaactcccagggctctggaaatggtgaggcgaggggcttgagaggaacgcccacccacgaaggcccagggcgccagacggccccgaaaaggcgctcggggagcgtttaaaggacactgtacaggccctccctccccttggcctctaggaggaaacagttttttagactggaaaaaagccagtctaaaggcctctggatactgggctccccagaactgctggccacaggatggtgggtgaggttagtatcaataaagatatttaaaccacca

SEQ ID NO: 34437 - DNA, 4041 bp, Homo sapiens
gaggggcgggggctggaggcagcagcgcccccgcactccccgcgtctcgcacacttgcaccggtcgctcgcgcgcagcccggcgtcgccccacgccgcgctcgctcctccctccctcctcccgctccgtggctcccgtgctcctggcgaggctcaggcgcggagcgcgcggacgggcgcaccgacagacggccccggggacgcctcggctcgcgcctcccgggcgggctatgttgattgccccgccggggccggcccgcgggatcagcacagcccggcccgcggccccggcggccaatcgggactatgaaccggaaagcgcggcgctgcctgggccacctctttctcagcctgggcatggtctacctccggatcggtggcttctcctcagtggtagctctgggcgcaagcatcatctgtaacaagatcccaggcctggctcccagacagcgggcgatctgccagagccggcccgacgccatcatcgtcataggagaaggctcacaaatgggcctggacgagtgtcagtttcagttccgcaatggccgctggaactgctctgcactgggagagcgcaccgtcttcgggaaggagctcaaagtggggagccgggaggctgcgttcacctacgccatcattgccgccggcgtggcccacgccatcacagctgcctgtacccagggcaacctgagcgactgtggctgcgacaaagagaagcaaggccagtaccaccgggacgagggctggaagtggggtggctgctctgccgacatccgctacggcatcggcttcgccaaggtctttgtggatgcccgggagatcaagcagaatgcccggactctcatgaacttgcacaacaacgaggcaggccgaaagatcctggaggagaacatgaagctggaatgtaagtgccacggcgtgtcaggctcgtgcaccaccaagacgtgctggaccacactgccacagtttcgggagctgggctacgtgctcaaggacaagtacaacgaggccgttcacgtggagcctgtgcgtgccagccgcaacaagcggcccaccttcctgaagatcaagaagccactgtcgtaccgcaagcccatggacacggacctggtgtacatcgagaagtcgcccaactactgcgaggaggacccggtgaccggcagtgtgggcacccagggccgcgcctgcaacaagacggctccccaggccagcggctgtgacctcatgtgctgtgggcgtggctacaacacccaccagtacgcccgcgtgtggcagtgcaactgtaagttccactggtgctgctatgtcaagtgcaacacgtgcagcgagcgcacggagatgtacacgtgcaagtgagccccgtgtgcacaccaccctcccgctgcaagtcagattgctgggaggactggaccgtttccaagctgcgggctccctggcaggatgctgagcttgtcttttctgctgaggagggtacttttcctgggtttcctgcaggcatccgtgggggaaaaaaaatctctcagagccctcaactattctgttccacacccaatgctgctccaccctcccccagacacagcccaggtccctccgcggctggagcgaagccttctgcagcaggaactctggacccctgggcctcatcacagcaatatttaacaatttattctgataaaaataatattaatttatttaattaaaaagaattcttccacctcgtcgggatccgttttctgcaatcaaagtggactgcttgctttcctagcaggatgattttgttgctaggacaaggagccgtgtagaagtgtacataactattctttatgcagatatttctactagctgattttgcaggtacccaccttgcagcactagatgtttaagtacaagaggagacatcttttatgcatatatagatatacacacacacatttttttttttttttttgctgtttgctgctacttatccagaaatttaagctggtccagatttggagacgttttttccagagtatgttttccatccttttgccctccccagttcaaacttcaccattagaaaaatccagtttggaataaatagagaggaaaaataataaattcccagcagtttccatctttcggaaagtgagccaccggataagagagaatattttgtaagagactatttttatatgaatattttatttatatcgagtctactgtatcattccacggcctgtgcttcttcttaattctggtactcacttaggggtaaggaggggcgatgcctggttgtggcgtcaggccccatggggccccttgcacagctggattcttgagttctgtttgccaagtgggcacaagctgcccctggatgcctggggttgaggcatcatctcatccatgttagccgggaaagaaatcaaatccccagcctcagcctgttaagctcaggcctttcaagcagggccactgagtggtagcttcgaaatgagtcactgtggtgggtggtcatcgtgcccctcacagggacttgaccgtcatcctgcagcagaggccagttcagggagccccacacctcaccaagacactagccattgcctgcgtgtcctggaaggtgagatgtagtcctcaggtgaggtgacccaaagcagatggggtgaggggccgatgagcagccgggcccagcggggcttcctggatatcctgctcccaaggccaagcagcagagagaggttcaagtgaggccactttgctttgggtccagctacacccagagcctcagcctagaaagctgtcctccagcaggctgggggtgttctaatatgtgtccgtttgcatttccggtgtgtgtgtgtgtgtgtgtgtgtgtgtgtgtgtgtgtgtgtgtgtgtactgtatcttcttagggacttgagtgtagtcacgtgactttgcgccttgcagcgcctccgccgtactcgtgtgtgtatgtgtctgtgtgtttccgtgctacccaagcgtctgtttctctccgtgtgcctgggagatcaggtctcaggcatggagctgcatgcctttgcatctgctgctccccagagtctctgcttgcatgtgagggctggtggtatgaggcagacagcagagattgtgtgtgattgtgttgaaccgccaagagaaggcacctctgaactctgtccccacacccatgggtgaaaaccagacacctctgagaccacagcacagccccatggccccacctgctgggagcccttcagtatctaggctgtgtctgactcctcagtgtccacactgagcctggatcacagcatgggcaaataaaagtgactggatggttgcatggtttcttcccttggacatttttttccatttttcttttacttgggtgtctggaggagtgggcatgtgaaggggccatggagtgaatggatggagggatggatgaatgtgtgagtaggtaggtaggtgaatgggtagatgtgtggatggataagtaggtgggtgggtgaatggataaatggatggatgggtagatggatggatgaagggataaacagatgggtggatggattgataagtgagcggatgaatggatgaatagctaggaaagtgggtgggtggatgagggtgggttgatgaggtaggtacacctacagataggtaagtgagcagtttcttgggagtccacaggtcacattttatctttgctttggaaaacctagcagatctgccatgatcaggatggcttcccgaccttgcaacccttctgcttctgacctccttggcacctgggaatgggggagattctgaccagcctccccagatgagtgttcaatgatagttacataaacacagtctcagaagagtcatccctgtgtcctccctcactgtgggttcccagctctggggcctgccctctctcgggtgccctgttcagctgtgctctgagccccagtttctccacctgtgaaatcagaataacacctacctcacagggctgttgtgaggatcctcccagtaatgactgtatggcactttgagttgcaaagcaatggatgaa

SEQ ID NO: 34438 - DNA, 3919 bp, Homo sapiens
attggccgccgcggcgctcggcgaggcgctcacggcctcaggcggctgcgcctagtgcaggctgcacccgcccgccagccgcgcccgggcccccggcccgcgcttgcaggggtccacggtcgctcaaccgggcttcgaggtcgcggcccccagcctgggtcaattccccgggctcacgcggcggtggcggcggcggcatcccgggctcaccatggtggcagcgcgcgccgagtgcccgcgcgtcgccggccgcccgagccgcagcgcgggctgagcgcagtctgcccgcagccccctggcccctgcccggccctgccgggcccgcgcgtcccctccggccgccgctgtctatggcgcagcccccctccctggatcatgcacagaaactttcgcaagtggattttctacgtgtttctctgctttggcgtcctgtacgtgaagctcggagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaaggttctagaggaccggatgcagctggagtgcaagtgccacggcgtgtctggctcctgcaccaccaaaacctgctggaccacgctgcccaagttccgagaggtgggccacctgctgaaggagaagtacaacgcggccgtgcaggtggaggtggtgcgggccagccgtctgcggcagcccaccttcctgcgcatcaaacagctgcgcagctatcagaagcccatggagacagacctggtgtacattgagaagtcgcccaactactgcgaggaggacgcggccacgggcagcgtgggcacgcagggccgtctctgcaaccgcacgtcgcccggcgcggacggctgtgacaccatgtgctgcggccgaggctacaacacccaccagtacaccaaggtgtggcagtgcaactgcaaattccactggtgctgcttcgtcaagtgcaacacctgcagcgagcgcaccgaggtcttcacctgcaagtgaggccaggcccggaggcggccgcgggcaccctggaacccggcggcattttgcacatccactcctcaccttccctgccttggtgctgccagcagcagacatagacgggtgcagaagcggggagctccaggtgcaggagggcaccggccggggcccacgccctctgcccgcctccctggggctccttcctgccacctcctcccatcacctcctgcggcagaacagcacccgtgacccacccagagagcaaggccaggggtcttggtgctccccgacggggcccggcaagttctctttcttctctctgggaaaatgaacgtccaggacacacctgtatcccagagagcaaagtgatgaggagactgagcgtccccagccccacctggcggcatggacacagaaaagctacgccggctggcctctccagaccagttcccaggctgggtctgccgctgggccctggggcggtggggacagatgttgacacaaattatttatgttttcttagtatcagaagaggattctcggcactaacacatagccagtcctaactccgtactctgtgtcagcccatcccctagacaccctctgtttcctttcccggccccacctggccggccctctgcccctgcagagctgaggcagcctggggttgatggggaccacgcggtgcctgcaggtcctagaagtgagctgggcaggggctcttcagaccacacagccctgaccgggccttggaggagagccatggacaggctcctccatgccgtctttccttcttttgaaaatcctatcaatggctgggcgcggtggctcacacctgtaatcccagcactttgggagaccgaggcaggtggatcacctgaggtcaggagttcgagaccagcctggccaacgtggtgaaaccctgtctctactaaaaatacaaaaattagctgggcgtggtggcgtgcacctgtaatcccagctactcaggaggctgagacaggacacttgcttgaacccgggaggtggaggttgcaatgagccaagattgtgccactgtattccaacttgggtgacagagcacgactctgtctcaaaaaaagaaaagaaaataatatcaagcaaatcaaaatatcacccacgtcaggttccaggagtccttcgttccctccctcatcctgtcaccctcccggcctggcacctccagtttacagagacccccttccccctggagccagcctgacccctgggacagtgctgccgcgggggtcaggcaggtggtgagtggtcagggatgtttgtcccacttgacagatgggaactctgaggcccagagtggcacaaggacctaccagagaccctgcagctgtgactggaggcttccacctttctcctgcccagcctggggctctggacctgggagaacacatcaggatgcccggggtggcagtaggtagctcccatgccttgaggcacttggctgctccctccaccccctgacagcctcattggggcctgcactcccctcggtgcctttgaggcttcgcctagccctgtcctggtccttttaccctgaccccagtgctgagaaaatctggatccagagctggacatgtcctttctggatgctcccacccctgtctctgaggagcatgagtgacagagggaggaacttgtccgaggccagagaggatggtctgcagctggctcctggtgcacccccactgcccacggcctggcccccatttagggtgtgttctcttggaagcccgtaggaatgtgttcttgagcagccgacaagccaagggcctgggctcagcctggggcaagtgggtccctcctgggctctggccctgtggtccagcccatgtgcctctaaccatgcctggacgctctgagtctccgggccaccgtgaatgccccaccctcagcctggccccatccccttaccttccccaagtcccagaacacacctgagtccataggcccggcagcctctgcaaggaacctggttaacttatgttgttatatagcgtcgaaatgtctatagtgtctttaaattattgtgacctacactgggtaccggagagggggatggctgcggcccccatccctcatcccccatcccatcccatccctcatctcatccctcatcccatcccccatcccatccctgaccccatcccccatcccatccctcatccctattccccatacccaccccccatcccatcccccatctcccgaaccaggctcctcctgcttcaacagacccttggggcccctgatgccaccgagacactcgcactgtcccttggctgccgggcaccccactgagcccctgcccaccccaaagtctgccagcaacaggccctttgcctgggtgagacgggggtcagggtggcccagatgggggtgatggcgaccaaggtgctgcgtccccacccttctgacggcagcctcccctggaggggagtgctcggcccaataaaagctggaatcggaaaagtga

SEQ ID NO: 34439 - DNA, 2285 bp, Homo sapiens
gggtgtcccagccaaggcaacttgggcaagccctggaggcggctcccaccgcacgctccggtcagcctcccctttaaaaaaacccgccgggggaggaggcggatgtaggggcggcccgtccaatggcagctgcgcgcctcgggagacttggagaagtgagccagagcgagcgacagagccggttcgcaccgacagacggacggaggtccagaccgcagccaaggcgcgcccgctgcccccggccgggtccccgccccgcactccagccccagctcccgccgctgccccagacccagcgccatgcgcggccctagcggcggggcacgggcgacaactgcgcccgggcccacgagacccggcccctagcgcccagcgccgccgccctgcatcggggagctccgcggggaccccggcctcagctggcccaggcgcccggcccgcggagcctgttcagccccgccaggcacgccggcccaccatgcttctactgtcgccgcgcagcgcgctcgtctccgtctattgcccgcagatctttctcctcctgtccagcggcagctacttagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaaggttctagaggaccggatgcagctggagtgcaagtgccacggcgtgtctggctcctgcaccaccaaaacctgctggaccacgctgcccaagttccgagaggtgggccacctgctgaaggagaagtacaacgcggccgtgcaggtggaggtggtgcgggccagccgtctgcggcagcccaccttcctgcgcatcaaacagctgcgcagctatcagaagcccatggagacagacctggtgtacattgagaagtcgcccaactactgcgaggaggacgcggccacgggcagcgtgggcacgcagggccgtctctgcaaccgcacgtcgcccggcgcggacggctgtgacaccatgtgctgcggccgaggctacaacacccaccagtacaccaaggtgtggcagtgcaactgcaaattccactggtgctgcttcgtcaagtgcaacacctgcagcgagcgcaccgaggtcttcacctgcaagtgaggccaggcccggaggcggccgcgggcaccctggaacccggcggcattttgcacatccactcctcaccttccctgccttggtgctgccagcagcagacatagacgggtgcagaagcggggagctccaggtgcaggagggcaccggccggggcccacgccctctgcccgcctccctggggctccttcctgccacctcctcccatcacctcctgcggcagaacagcacccgtgacccacccagagagcaaggccaggggtcttggtgctccccgacggggcccggcaagttctctttcttctctctgggaaaatgaacgtccaggacacacctgtatcccagagagcaaagtgatgaggagactgagcgtccccagccccacctggcggcatggacacagaaaagctacgccggctggcctctccagaccagttcccaggctgggtctgccgctgggccctggggcggtggggacagatgttgacacaaattatttatgttttcttagtatcagaagaggattctcggcactaacacatagccagtcctaactccgtactctgtgtcagcccatcccctagacaccctctgtttcctttcccggccccacctggccggccctctgcccctgcagagctgaggcagcctggggttgatggggaccacgcggtgcctgcaggtcctagaagtgagctgggcaggggctcttcagaccacacagccctgaccgggccttggaggagagcca

SEQ ID NO: 34440 - DNA, 714 bp, Homo sapiens
cgcgtcccctccggccgccgctgtctatggcgcagcccccctccctggatcatgcacagaaactttcgcaagtggattttctacgtgtttctctgctttggcgtcctgtacgtgaagctcggagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaagggcctacttggacaacccagggtgacctcctctccgttgtttccttgaccacatctgtaaaggccctacttccaaataaagtcacttgccgag

SEQ ID NO: 34441 - DNA, 2202 bp, Homo sapiens
ctggcgcggcccggcgggcgggcgcccggcgagccgcgctagctgctctctgcggtagctgctccgagtcgtatttccacattcctgaacccagccgagtccttacctgttgagccgcgatctcctttagacagaatctgtctcggcttcgctcgaagtgggggtggagaaacggcgtgacggagagggggtgcggtgcacctcgcctggggcgcccaccgcccgctgctggccccgcgctcctcgcacctgcggggacccgggccccgccgcgccctgcgcgcctactgtgcgccgccggctgccccgaggcgagccccgtccaggccacaggcaaggcggtgaacagacccgcgggaggggcaggtgcaggtaccactggtgggagacgcggcttcccaggcggagaggtggaagcaggcgctgggaatcgtctctccatcaccctccatcccatgtctgccccgccattttacagagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaaggttctagaggaccggatgcagctggagtgcaagtgccacggcgtgtctggctcctgcaccaccaaaacctgctggaccacgctgcccaagttccgagaggtgggccacctgctgaaggagaagtacaacgcggccgtgcaggtggaggtggtgcgggccagccgtctgcggcagcccaccttcctgcgcatcaaacagctgcgcagctatcagaagcccatggagacagacctggtgtacattgagaagtcgcccaactactgcgaggaggacgcggccacgggcagcgtgggcacgcagggccgtctctgcaaccgcacgtcgcccggcgcggacggctgtgacaccatgtgctgcggccgaggctacaacacccaccagtacaccaaggtgtggcagtgcaactgcaaattccactggtgctgcttcgtcaagtgcaacacctgcagcgagcgcaccgaggtcttcacctgcaagtgaggccaggcccggaggcggccgcgggcaccctggaacccggcggcattttgcacatccactcctcaccttccctgccttggtgctgccagcagcagacatagacgggtgcagaagcggggagctccaggtgcaggagggcaccggccggggcccacgccctctgcccgcctccctggggctccttcctgccacctcctcccatcacctcctgcggcagaacagcacccgtgacccacccagagagcaaggccaggggtcttggtgctccccgacggggcccggcaagttctctttcttctctctgggaaaatgaacgtccaggacacacctgtatcccagagagcaaagtgatgaggagactgagcgtccccagccccacctggcggcatggacacagaaaagctacgccggctggcctctccagaccagttcccaggctgggtctgccgctgggccctggggcggtggggacagatgttgacacaaattatttatgttttcttagtatcagaagaggattctcggcactaacacatagccagtcctaactccgtactctgtgtcagcccatcccctagacaccctctgtttcctttcccggccccacctggccggccctctgcccctgcagagctgaggcagcctggggttgatggggaccacgcggtgcctgcaggtcctagaagtgagctgggcaggggctcttcagaccacacagccctgaccgggccttggaggagagcca

SEQ ID NO: 34442 - DNA, 521 bp, Homo sapiens
gccgcgatctcctttagacagaatctgtctcggcttcgctcgaagtgggggtggagaaacggcgtgacggagagggggtgcggtgcacctcgcctggggcgcccaccgcccgctgctggccccgcgctcctcgcacctgcggggacccgggccccgccgcgccctgcgcgcctactgtgcgccgccggctgccccgaggcgagccccgtccaggccacagagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagc

SEQ ID NO: 34443 - DNA, 2112 bp, Homo sapiens
cgcttacacaccaaggaagttgggctttgagaattccatcccactggcactgaggagaatatttctccgtcttgcttacccatctcccagttttttggaattttctctagctgttactccagaggattatgtttctttcaaagccttctgtgtacatctgtcttttcacctgtgtcctccaactcagccacagctggtcggtgaacaatttcctgatgactggtccaaaggcttacctgatttactccagcagtgtggcagctggtgcccagagtggtattgaagaatgcaagtatcagtttgcctgggaccgctggaactgccctgagagagccctgcagctgtccagccatggtgggcttcgcagtgccaatcgggagacagcatttgtgcatgccatcagttctgctggagtcatgtacaccctgactagaaactgcagccttggagattttgataactgtggctgtgatgactcccgcaacgggcaactggggggacaaggctggctgtggggaggctgcagtgacaatgtgggcttcggagaggcgatttccaagcagtttgtcgatgccctggaaacaggacaggatgcacgggcagccatgaacctgcacaacaacgaggctggccgcaaggcggtgaagggcaccatgaaacgcacgtgcaagtgccacggcgtgtctggcagctgcaccacgcagacctgttggctgcagctgcccgagttccgcgaggtgggcgcgcacctgaaggagaagtaccacgcagcactcaaggtggacctgctgcagggtgctggcaacagcgcggccggccgcggcgccatcgccgacacctttcgctccatctctacccgggagctggtgcacctggaggactccccggactactgcctggagaacaaaacgctagggctgctgggcaccgaaggccgagagtgcctaaggcgcgggcgggccctgggtcgctgggaacgccgcagctgccgccggctctgcggggactgcgggctggcggtggaggagcgccgggccgagaccgtgtccagctgcaactgcaagttccactggtgctgcgcagtccgctgcgagcagtgccgccggagggtcaccaagtacttctgtagccgcgcagagcggccgcgggggggcgctgcgcacaaacccgggagaaaaccctaagggtttcctctgccccctccttttcccactggttcttggcttcctttagagaccccggtaattgtggaacctagggaatggggaacccgctctcccagacctagggatcctgagagggagagactgcaatttctccaaagcttgccactttccagcctgtttccccaattcctctgtgctctcctagagctctgtctgaatcctcgcagccacacctaggtctgagaactcaggctttgagttactgatcttccttggattaggagaacaggtgttcctcctcccctctcctagcagccctaatgtctgacctagcctatcaagccttaggcgctggaagaacccttctcagacacgcaggacccaggtaaagtcaaagctttgcccttttgcccactgtctgctaccagggctcacccactgctgcacctctcttctgcacagctcctcccctgctacctgctgagccagattccccaggaatcttgaatgctttctctcctcttctccctttcctttcccagaaaaactgaggaaactggccccggaaaagcatgtctttggggttggttcctagaggcagaggttgaagatggaagagggagctctggagtgctaacttgaacaccaagggtgctactcatccctatggtatcatatcatgaatggactttactagtggggcaatgactttcctagacaataacccgagggactccagatacataccccgaaggtctaggaaatacgttaagggcagattacagtcatttcctaccctttaaaggtaacttctcccttctcctgacctacttcctcctagcaaccaactttacctcttcttctccaaaggatctttgttcctctgagccaagactgaggtaaataaagccactttcctcttcagatcctggtctgcacctctaga

SEQ ID NO: 34444 - DNA, 1814 bp, Homo sapiens
gattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacagcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgt

SEQ ID NO: 34445 - DNA, 6302 bp, Homo sapiens
gcgagcggctgttggaggaaggaggtgggggccgggagcgcaaatggcgttgagatggttcagggccctgttcaaactccagcactgaccattcaccggcggaagcggcggcgcaggaggcggcggcggcccagcgggggcacacagcaggctctgttaccagctccagcagtggcggccagcgagagctaggcctgggcccggccggcggcgctcgaggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacagcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccgtaaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaataca

SEQ ID NO: 34446 - DNA, 6200 bp, Homo sapiens
gcgcggggactgtgggaagcggagtgacggagcgagcggctgttggaggaaggaggtgggggccgggagcgcaaatggcgttgagatggttcagggccctgttcaaactccagcactgaccattcaccggcggaagcggcgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacagcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccgtaaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaataca

SEQ ID NO: 34447 - DNA, 1801 bp, Homo sapiens
agaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacagcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaa

SEQ ID NO: 34448 - DNA, 6114 bp, Homo sapiens
atggttcagggccctgttcaaactccagcactgaccattcaccggcggaagcggcgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacagcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccgtaaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaatac

SEQ ID NO: 34449 - DNA, 1849 bp, Homo sapiens
gctgctcattgcggaagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagctgagcactggaccaaggagcattgtggggctgtgtgcttcgtgaaggataacccccagaagtcctacttcatccgcctttacggccttcaggctggtcggctgctctgggaacaggagctgtactcacagcttgtctactccacccccacccccttcttccacaccttcgctggagatgactgccaagcggggctgaactttgcagacgaggacgaggcccaggccttccgggccctcgtgcaggagaagatacaaaaaaggaatcagaggcaaagtggagacagacgccagctacccccaccaccaacaccagccaatgaagagagaagaggagggctcccacccctgcccctgcatccaggtggagaccaaggaggccctccagtgggtccgctctccctggggctggcgacagtggacatccagaaccctgacatcacgagttcacgataccgtgggctcccagcacctggacctagcccagctgataagaaacgctcagggaagaagaagatcagcaaagctgatattggtgcacccagtggattcaagcatgtcagccacgtggggtgggacccccagaatggatttgacgtgaacaacctcgacccagatctgcggagtctgttctccagggcaggaatcagcgaggcccagctcaccgacgccgagacctctaaacttatctacgacttcattgaggaccagggtgggctggaggctgtgcggcaggagatgaggcgccaggagccacttccgccgcccccaccgccatctcgaggagggaaccagctcccccggccccctattgtggggggtaacaagggtcgttctggtccactgccccctgtacctttggggattgccccacccccaccaacaccccggggacccccacccccaggccgagggggccctccaccaccaccccctccagctactggacgttctggaccactgccccctccaccccctggagctggtgggccacccatgccaccaccaccgccaccaccgccaccgccgcccagctccgggaatggaccagcccctcccccactccctcctgctctggtgcctgccgggggcctggcccctggtgggggtcggggagcgcttttggatcaaatccggcagggaattcagctgaacaagacccctggggccccagagagctcagcgctgcagccaccacctcagagctcagagggactggtgggggccctgatgcacgtgatgcagaagagaagcagagccatccactcctccgacgaaggggaggaccaggctggcgatgaagatgaagatgatgaatgggatgactgagtggctgagttacttgctgccctgtgctcctccccgcaggacatggctccccctccacctgctctgtgcccaccctccactctcctcttccaggcccccaaccccccatttcttccccaccaacccctccaatgctgttatccctgcctggtcctcacactcacccaacaatcccaaggccctttttatacaaaaattctcagttctcttcactcaaggatttttaaagaaaaataaaagaattgtctttctgtctctctataaa

SEQ ID NO: 34450 - DNA, 933 bp, Homo sapiens
tcaagactaagtcaaaggaggagagggcaacgcggtgggcaggagagaggccaacggccgcccggggcgaggggagccggtaggacgggaccaggactggccgacccggccccgcgcggggaagggggcgccttcctcccacaacacaaaacgtggaaatggggttttgccatgttgcccaggctcgtcttgaactcctgacctcaagtgatccactcgtctcggcctcccaaagtgctgggattacagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagctgagcactggaccaaggagcattgtggggctgtgtgcttcgtgaaggataacccccagaagtcctacttcatccgcctttacggccttcaggctggtcggctgctctgggaacaggagctgtactcacagcttgtctactccacccccacccccttcttccacaccttcgctggagatgactgccaagcggggctgaactttgcagacgaggacgaggcccaggccttccgggccctcgtgcaggagaagatacaaaaaaggaatcagaggcaaagtggagacagacgccagctacccccaccaccaacaccagccaatgaagagagaagaggagggctcccacccctgcccctgcatccaggtggagaccaaggaggccctccagtgggtccgctctccctggggctggcgacagtggacatccagaaccctgacatcacgagttcacgataccgtgggctcccagc

SEQ ID NO: 34451 - DNA, 9494 bp, Homo sapiens
ctcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 34452 - DNA, 10452 bp, Homo sapiens
ccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 34453 - DNA, 8588 bp, Homo sapiens
atggatattaaaaagaaagatttttgctcagtatttgtcatcataaattctcattgctgctgctgccctcaaaaggattgtataaatgagggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 34454 - DNA, 1902 bp, Homo sapiens
ccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtatgtttcaggtgtaccttggagcctgactggctttctcacattccttttatttagaatcctggctctgtcagagttttaagtgatataaaccttaagaaattcatagcttgaactcaggaggtgatccattgtacttatgagatataggattctctatatttgtgcttcttggaatcatcttagagactattggtaacattacgttacaagaaataaagtgaactttgttgataaaa

SEQ ID NO: 34455 - DNA, 8643 bp, Homo sapiens
atgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcctcgtcgtggccgtagcatgtcggtttgtgttcccatctttctgctgttgcctctgtgtcccgcatctctcccagtgctcttccaccccaccgccagtactgtctgcacctctttctccttccctcctccggactgccccgaggaaacttttgccgaaaagctttctaaagcattggagagtgtcctgcctatgcactctgcctctcagcgcaagcaccgacgctccagcctgccttccctctttgtcagtactcctcagtccatggcgcatccgtgtggggggaccccaacatacccagaatcacagatatttttcccaactattcatgaacgtccagtttctttttcaccacctcccacctgcccaccgaaagtagccatttcccagcggcgtaagagcacctccttcctggaagcccaaactcaccacttccaacccctgctgaggactgttggccaaagtcttcttccacctggtggcagcccaactaactggacaccagaggccgtagttatgttgggtactacagccagtagagtaactggagagtcatgtgagatacaggtccatcctatgtttgaaccatctcaagtttacagtgactatagacctggactagtacttccagaagaagctcactattttattcctcaggaagcagtgtatgtagctggggtacattaccaggcccgggtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaactggccaataggaagcccagaatattccagtgattcctcacaaatcacttcttcagaccccagtgattttcagtcacctccccctacagggggagcagctgcaccttttggctctgacgtctcaatgccctttatccatctgcctcagacagtgttacaagaatccccacttttcttctgtttcccccaaggaaccacatctcagcaggtcttaactgcctcattttcttcaggaggatctgcacttcatccacaggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttag

SEQ ID NO: 34456 - DNA, 9886 bp, Homo sapiens
atttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaaggtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaa

SEQ ID NO: 34457 - DNA, 4614 bp, Homo sapiens
cggcgccgcagagaagcagagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttag

SEQ ID NO: 34458 - DNA, 11232 bp, Homo sapiens
ccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcctcagtccatggcgcatccgtgtggggggaccccaacatacccagaatcacagatatttttcccaactattcatgaacgtccagtttctttttcaccacctcccacctgcccaccgaaagtagccatttcccagcggcgtaagagcacctccttcctggaagcccaaactcaccacttccaacccctgctgaggactgttggccaaagtcttcttccacctggtggcagcccaactaactggacaccagaggccgtagttatgttgggtactacagccagtagagtaactggagagtcatgtgagatacaggtccatcctatgtttgaaccatctcaagtttacagtgactatagacctggactagtacttccagaagaagctcactattttattcctcaggaagcagtgtatgtagctggggtacattaccaggcccgggtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaactggccaataggaagcccagaatattccagtgattcctcacaaatcacttcttcagaccccagtgattttcagtcacctccccctacagggggagcagctgcaccttttggctctgacgtctcaatgccctttatccatctgcctcagacagtgttacaagaatccccacttttcttctgtttcccccaaggaaccacatctcagcaggtcttaactgcctcattttcttcaggaggatctgcacttcatccacaggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 34459 - DNA, 7138 bp, Homo sapiens
atggacggcgatggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggtccatgcagggggctcaccctgccctgtctcccatggcgcagagcagcctgtggggctgtgttcctatccttgttttctgctgaatcagctcagtcaaagcagcctccagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagcagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatggcgccctcggaaccgcccggagaaaccaggtgtggtttggcctccgagtcccccccaccgcctgctgtgggcacagcactcagccgcgagggggacagcgggtgggcagcaagactgcttcctttgcggcttcagaccctgttcgctcctaggttcctgtggtccacgcgccgtctccacacccacttcctatacttgagttgatggttagaaccttgtcgtcaccctgcagaagtacagtgccttgaatgccagcttttccgttccctgatgaaaagatatgttaaaaaaaattatcggaaaaggtttcatttgcaattggcttgtgcattgataatctttatttactgttttaagttgcagagatgtgaatggtttacaaatctgaagctgaag

SEQ ID NO: 34460 - DNA, 6945 bp, Homo sapiens
atggacggcgatggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggtccatgcagggggctcaccctgccctgtctcccatggcgcagagcagcctgtggggctgtgttcctatccttgttttctgctgaatcagctcagtcaaagcagcctccagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagcagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatcctgagagtgagaagcctgactgaccccgcctagacgccaggcccacttcacgccgtctaagtggagaagtgacggaccctcagggccagctgctcctcctgtccagttcacgctgttttgtaaccactttctaagcattttttattcacaattggaaacacaaatgtaatgcaagaataaaaaatattttggggcagaaagga

SEQ ID NO: 34461 - DNA, 6821 bp, Homo sapiens
atggacggcgatggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccacctcctgcagaggccttctcgggccgtcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatcctgagagtgagaagcctgactgaccccgcctagacgccaggcccacttcacgccgtctaagtggagaagtgacggaccctcagggccagctgctcctcctgtccagttcacgctgttttgtaaccactttctaagcattttttattcacaattggaaacacaaatgtaatgcaagaataaaaaatattttggggcagaaagga

SEQ ID NO: 34462 - DNA, 6678 bp, Homo sapiens
atggacggcgatggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagcagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatcctgagagtgagaagcctgactgaccccgcctagacgccaggcccacttcacgccgtctaagtggagaagtgacggaccctcagggccagctgctcctcctgtccagttcacgctgttttgtaaccactttctaagcattttttattcacaattggaaacacaaatgtaatgcaagaataaaaaatattttggggcagaaagga

SEQ ID NO: 34463 - DNA, 6834 bp, Homo sapiens
atggacggcgatggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagcagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatcctgagagtgagaagcctgactgaccccgcctagacgccaggcccacttcacgccgtctaagtggagaagtgacggaccctcagggccagctgctcctcctgtccagttcacgctgttttgtaaccactttctaagcattttttattcacaattggaaacacaaatgtaatgcaagaataaaaaatattttggggcagaaagga

SEQ ID NO: 34464 - DNA, 6675 bp, Homo sapiens
atggacggcgatggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagcagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccaggttcctgtggtccacgcgccgtctccacacccacttcctatacttga

SEQ ID NO: 34465 - DNA, 11341 bp, Homo sapiens
ctcagctccgggccgagcgcgagcttgggctcgtaccccgctcccctctctccgcccgctctttacctaccggccgtagctggcccggtgggctcgcggggagacgctcgcgcgcgcaagcgcacacgacgcggagcggagctcgagacatcgaggagaggagtaagaagcatcggaggaggcgatcgaggaggaggcggtgtgtgtgtatgtgtctattctacggtgtggctcgtcgtggggcgagaggaggctcgagagagggcgagggagaagcgaaaagagtaagagagtcttcctttgcgagagcctctaatctggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtggcataaaaccagccagcttcaataaagtcactgatcctgaagtcaaagaaatcattgaaggatgtattcgtcaaaacaaatctgaaaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcagggttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaagcctgtatcccaaccagttggagctgaacaacaagcagctcttctaaaaccagatttagttcgaagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtatcaacctctggagataacatggtagagtgtcagctggagacacacaacaacaagatggtcaccttcaagtttgatgttgatggtgatgcgccagaggatattgcagactatatggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccagacagggtcatctgaacaagtacagataaattctacatctactcaaaccagcaatgaatctgctcctcagtcatccccagttggtcggtggcgattctgtatcaatcagacgataagaaaccgtgagactcagtctcctccttctcttcagcattccatgtctgcggttcctggccgacatccacttcctagtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgagatgtcctcagatgcttcacttccaggggatccagaggcctatcctgctgctgtgtcaagcggtggagccattcatctgcagacaggaggtggatattttggcctaagctttacttgtcctagtctcaaaaatcctattagcaagaaatcctggactcgcaaattaaaaagctgggcatacaggctacggcagtcaaccagctttttcaagagatcaaaagtccgtcaagtggaaacagaagagatgagatcagcaattgctcctgatcccattcctctgacacgggagtccacagctgatactagggctttgaatagatgtaaagcgatgagtggatcatttcagcggggtcggttccaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaaacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacagggaaaagctgccttataaatgagttggaaaatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaaaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatgaatcagagtagatggtgataaaaagggaggttttttcagaattattttcaggacacccaagatattaaagtttcttcctcttgggttctgtcatattttccctcatttgagtttactttagactatatattttttgttccagtgtggtatttgatacagctcatcattctgtagaaatgtgcagtttgcagatagaacactgcacacagaaatgttttttcacttcaaattctatcctctttgatacttgattttttaaaaatactgttcagaatgctttaataagctcagcttgagcattaccatttccaggacactttccatgaattgttgagaagctccccatcccccgccttttttttttttttttttaactgctgctatctgcagctggatactcttctttaaaaatgtttaaaaattatttagattgattctccccaaatgtggatgaactgagaccctccatcagccagagtcttatgggatcttcacttcacatgtttgtcttaggtttacctttcacagaaggcagggtaacttgctgcaggaaacgttttggtgtataaaattagaatcacttttttttttttttttgagatggagtctctctctgtcacccaggttggagtgcagtggtgtgatcttggctcactgctgcaacctccccctcctgggttcaagcgattctcctgcctcagcctcctgagtagctgggactacaggcgccagccaccatgcctggctaatttttgtatttttagtagaggatggggtttcactatgttggccagactggtctcaaactcctaaccttgtgatccgccctccttagcccccccaaaaaattacaataattttgtcaaccaatacagaacatgagccctttttaaatgtgatttcccgtcatcacagcagtaggatgaagccttgttttgggtgagacagagggaaagggaaaaaacagaattgtaacagttccttgattctgcagatactgctgctgttttacgatttcagtaataattcaaagcagctgtctccttgtttctcacatgcatactacattggttttgagcatctgagaggcattggtttgtcttgcattcttttgcaaggcatatattgcagctgatatgaatctcgtttggggggaatccttgtattcctaacaagggggattaaagctacacctcaatccattcttctgaagtgaaatttacttgacacagtaggtttcgagacttacatatgaaacactggctttacagggttctcagagatgtggggtatacactgtcctgcagtgagatagtagaccctagaaggatactatttaagttgtccttagctctttttaattacaatttttagttgttagaatttctttttagtatctatagtatcttagatgattttagatcttaaatgagtttggcagcctctttagaatctgagagagatcactgtcaagttgcactttactgggttttatccagttttaggaggaggggaggcaatgtcaaaatgtacacctttggtttttaagaaggttaactataataatgttaaaggctagtcacagggttacctaatgctcagtctgtgaaacctaaatagaattcttaaaatgttatttaccaactaagtattcatgttcaaattacttaccttccactctgaagactttaaggtcatttctaatacacatttacctaattaggagttctgtctactagtaaacattccaaattgctacccaacattactgttaacagattttcctccgtattcttctaaaaattataccccatgggcttgccaggtaatgacgaaaacttaatgggtgtacttttttttttttttgcacagtctactttgtgacattaagtacctcttttccaaaaaaaaaaaaaaatgtgttttatgttgcttacctgaggatcacatccattatcaagaagattctgtcgctataatttgaggcatctagggcagcattttgagaattgctgttgataagatccactgtttcttttcatagaacatgatctgttttgtatgagtctttccaaatgttaagtacagattcttcaaatttcttgtacagtattggtttgcagtttaaagtgattttaggacattagtgtaatgcaaatgcttgcattgcactgttttccatatgtataaaaacaatgctcctaaaatccctaattctttaaaactgcctgtgtttcattataaaaagttggctttgtgtaattacaccgagccatacaacctataaagtgaaaatactgcagattttaggaccccttcttctctagtcacaatcattttaaacagtgtaccccaggatgaaaaaagctccatggctgacatgtacaattacatgtattaatgactgctctacatcctatgttctgcctttggccaccacctctattccacatataattcatcattcttgtttgcctgcagactcttgcagtgccttgtaatatttacaatcttttcaggtttttgctggaaagaaaagtagtcttctaaagtttgaagatggtgaatagtgtactgctgtctccatgctgactgcagtaaccgggttatcatatatgttatgtatacattatgtatatataacatgtgtacatttaaaaatacagaaaaaagtgagcttgtgcagaaatggagaaaacaatgttattctcatcactgtggggttttattaaaattattttttcccatgacttacatgtttggttcagattatagtcactttgactgtaaatactggctagttttctatccagggcttttgcattatttcataattttgctaaatcatataatagtgctattttcatccttgtctgaggtacttttcctccccagaaataattaacttgaggtaaagctcagaaattcccttcttaacaaagagcctactatataaaaagggccttcctttccaaaaaacacacaaacctgtccttttcattttccttcttgtagaggagaaaatggttgtacttaaccatcctgcttgtaaagtttattcagaggatagtctgtatgtccagccaccatgtttacttctcaaagtgcaagtctgatgaatagtactgtatctccatatgtggtaatgtgagcatttcatcatgaagtacctgctgctatgtctgtgaagttgggtgtaacatcataagaatatgaaaccagtattggtgtaaatctaatgaaaataaccctatgtatatttgtagcagtcttgaatctctatttaaggtaatttgctgtaatataacaaatattcattctgtttttcatcccttccttgccagttttatatcaagcatgaattccaatggtttgacagcaaaattatctgtgaaagtttaaaaggcacttttctgctgtgatttttggattgagtgtggagtgttatgtacagtttgatgggatatatcattttagaaccccagatttaattctagtccaattaattttgtttaactacctcgttttcagtgctgttttgggtgcacaagtaaacactacctgtgaaacttgcttttttgccttgattctcagtattctttcagattataaatctggtctgcctcttttttcccagtgctagccaacagtttgagatgagagggatcatcactctcatctgtgtttaagtggagagccatgtgcttctgtgaaatatgctttggggatttgggggtggagagcagaagaataattgaaattggtggcaatataggatttaggtgtaggagttagttataaaataaacaaatggtaagaaagtacctgaattagacaatccagtgcctataactttgcattttttattagagatgcatttctcgtctgtgtgcctaaagggcaatgggttgaaattgctttaactaccacagcgaaatatttgacaaatccttcagcaatggcctatcattcaacatatattagcacagtgctaggtatttgcagtggtattttgttaccttaaaacggccaaatgcatttagttgaaatgtagttgatagtaagggttttatataactttatccaatctctaaagtttatggaagcattgactttcttctttgctgtcttttctgagtgatgaaaatgatgcattccttttttttccttgaaaactcagcaaatgtttgtaaccagatgttccttgtttcacatgtttactgtgtaacactacagcatatttaatattggtaaatactgtatttcagtcattatgcataagtacattcctgaggtatatttgccatcattttgggattcagttattttatcttctgtttgggtcagaaaaacttgaactatctgaggtggtatgcaggccattttctagaagattgttttttgaatctgtagtttatcaaggacttgttccccccctccctttgtttagaagaggaatcagaaaaggggggtggtgtgtagaaaaggcctttgatttgataggtgtaatttctaagattgaaattttaaaaatgcagatcgtaagatagtaacactcaaacttgataaaatcctttgaattgaaattagtatgaaatttttatggaaccaaatgccttcaggtcaccctggaaatagtctttgtatgtgaaagatcaacacaaacattggtcaggaaccctgacagccaatatatgaaggagcctgggatagtaactaggttacactaaagttattttcaactaagatagctagacgagtgtacaaaccaatagctcctattctggaaggttttctttttattaaaaaaaattcaaacaaggttaaaagtcaagcaagaagggaagagagaaactgggttctgagaaaaaaatgtgccagtataaaataaactcctaaatgcgtgcttgtcatcctctagtttttttttaagttgaatttcttttccactgtaacttaagatttgagattgaggtttgcggtccagaacataccctcagcagatacagtgactaactggaaagtgcagttgttcaaggtctgtcatgctcaatcacctaaagctataatttgtttgatatattaagcatgtagacctagtgcagcatgggagccactcaggaagtttatgcaattaataaactttcagcataatttactatgaagtatgcagaatttcaccctcttctccacacttaacatttagttgtatatgtgaactctcctttcttaattggggaatgtagcattatatagaatgttgttaaagttaattttaatcctttttgacattaacctttttttttttttggtaaaccaagtgatctgcctttcagcaactgtcttattttggttctttgaaactgtgatttttatttcatttgtacccaaccattgtaagtattttgttttgtttcctggaaattctgttttgaaacagaaaataaaggctgtgttaaatgagtatgttatcttattaaaatgctgccatagtcactgc

SEQ ID NO: 34466 - DNA, 5403 bp, Homo sapiens
atggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtggcataaaaccagccagcttcaataaagtcactgatcctgaagtcaaagaaatcattgaaggatgtattcgtcaaaacaaatctgaaaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcagggttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaagcctgtatcccaaccagttggagctgaacaacaagcagctcttctaaaaccagatttagttcgaagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtatcaacctctggagataacatggtagagtgtcagctggagacacacaacaacaagatggtcaccttcaagtttgatgttgatggtgatgcgccagaggatattgcagactatatggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccagacagggtcatctgaacaagtacagataaattctacatctactcaaaccagcaatgaatctgctcctcagtcatccccagttggtcggtggcgattctgtatcaatcagacgataagaaaccgtgagactcagtctcctccttctcttcagcattccatgtctgcggttcctggccgacatccacttcctagtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgagatgtcctcagatgcttcacttccaggggatccagaggcctatcctgctgctgtgtcaagcggtggagccattcatctgcagacaggaggtggatattttggcctaagctttacttgtcctagtctcaaaaatcctattagcaagaaatcctggactcgcaaattaaaaagctgggcatacaggctacggcagtcaaccagctttttcaagagatcaaaagtccgtcaagtggaaacagaagagatgagatcagcaattgctcctgatcccattcctctgacacgggagtccacagctgatactagggctttgaatagatgtaaagcgatgagtggatcatttcagcggggtcggttccaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaaacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacagggaaaagctgccttataaatgagttggaaaatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaaaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatga

SEQ ID NO: 34467 - DNA, 11172 bp, Homo sapiens
ctcagctccgggccgagcgcgagcttgggctcgtaccccgctcccctctctccgcccgctctttacctaccggccgtagctggcccggtgggctcgcggggagacgctcgcgcgcgcaagcgcacacgacgcggagcggagctcgagacatcgaggagaggagtaagaagcatcggaggaggcgatcgaggaggaggcggtgtgtgtgtatgtgtctattctacggtgtggctcgtcgtggggcgagaggaggctcgagagagggcgagggagaagcgaaaagagtaagagagtcttcctttgcgagagcctctaatctggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtggcataaaaccagccagcttcaataaagtcactgatcctgaagtcaaagaaatcattgaaggatgtattcgtcaaaacaaatctgaaaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcagggttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaagcctgtatcccaaccagttggagctgaacaacaagcagctcttctaaaaccagatttagttcgaagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtatcaacctctggagataacatggtagagtgtcagctggagacacacaacaacaagatggtcaccttcaagtttgatgttgatggtgatgcgccagaggatattgcagactatatggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccagacagggtcatctgaacaagtacagataaattctacatctactcaaaccagcaatgaatctgctcctcagtcatccccagttggtcggtggcgattctgtatcaatcagacgataagaaaccgtgagactcagtctcctccttctcttcagcattccatgtctgcggttcctggccgacatccacttcctagtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgagatgtcctcagatgcttcacttccaggggatccagaggcctatcctgctgctgtgtcaagcggtggagccattcatctgcagacaggagtggaaacagaagagatgagatcagcaattgctcctgatcccattcctctgacacgggagtccacagctgatactagggctttgaatagatgtaaagcgatgagtggatcatttcagcggggtcggttccaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaaacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacagatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaaaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatgaatcagagtagatggtgataaaaagggaggttttttcagaattattttcaggacacccaagatattaaagtttcttcctcttgggttctgtcatattttccctcatttgagtttactttagactatatattttttgttccagtgtggtatttgatacagctcatcattctgtagaaatgtgcagtttgcagatagaacactgcacacagaaatgttttttcacttcaaattctatcctctttgatacttgattttttaaaaatactgttcagaatgctttaataagctcagcttgagcattaccatttccaggacactttccatgaattgttgagaagctccccatcccccgccttttttttttttttttttaactgctgctatctgcagctggatactcttctttaaaaatgtttaaaaattatttagattgattctccccaaatgtggatgaactgagaccctccatcagccagagtcttatgggatcttcacttcacatgtttgtcttaggtttacctttcacagaaggcagggtaacttgctgcaggaaacgttttggtgtataaaattagaatcacttttttttttttttttgagatggagtctctctctgtcacccaggttggagtgcagtggtgtgatcttggctcactgctgcaacctccccctcctgggttcaagcgattctcctgcctcagcctcctgagtagctgggactacaggcgccagccaccatgcctggctaatttttgtatttttagtagaggatggggtttcactatgttggccagactggtctcaaactcctaaccttgtgatccgccctccttagcccccccaaaaaattacaataattttgtcaaccaatacagaacatgagccctttttaaatgtgatttcccgtcatcacagcagtaggatgaagccttgttttgggtgagacagagggaaagggaaaaaacagaattgtaacagttccttgattctgcagatactgctgctgttttacgatttcagtaataattcaaagcagctgtctccttgtttctcacatgcatactacattggttttgagcatctgagaggcattggtttgtcttgcattcttttgcaaggcatatattgcagctgatatgaatctcgtttggggggaatccttgtattcctaacaagggggattaaagctacacctcaatccattcttctgaagtgaaatttacttgacacagtaggtttcgagacttacatatgaaacactggctttacagggttctcagagatgtggggtatacactgtcctgcagtgagatagtagaccctagaaggatactatttaagttgtccttagctctttttaattacaatttttagttgttagaatttctttttagtatctatagtatcttagatgattttagatcttaaatgagtttggcagcctctttagaatctgagagagatcactgtcaagttgcactttactgggttttatccagttttaggaggaggggaggcaatgtcaaaatgtacacctttggtttttaagaaggttaactataataatgttaaaggctagtcacagggttacctaatgctcagtctgtgaaacctaaatagaattcttaaaatgttatttaccaactaagtattcatgttcaaattacttaccttccactctgaagactttaaggtcatttctaatacacatttacctaattaggagttctgtctactagtaaacattccaaattgctacccaacattactgttaacagattttcctccgtattcttctaaaaattataccccatgggcttgccaggtaatgacgaaaacttaatgggtgtacttttttttttttttgcacagtctactttgtgacattaagtacctcttttccaaaaaaaaaaaaaaatgtgttttatgttgcttacctgaggatcacatccattatcaagaagattctgtcgctataatttgaggcatctagggcagcattttgagaattgctgttgataagatccactgtttcttttcatagaacatgatctgttttgtatgagtctttccaaatgttaagtacagattcttcaaatttcttgtacagtattggtttgcagtttaaagtgattttaggacattagtgtaatgcaaatgcttgcattgcactgttttccatatgtataaaaacaatgctcctaaaatccctaattctttaaaactgcctgtgtttcattataaaaagttggctttgtgtaattacaccgagccatacaacctataaagtgaaaatactgcagattttaggaccccttcttctctagtcacaatcattttaaacagtgtaccccaggatgaaaaaagctccatggctgacatgtacaattacatgtattaatgactgctctacatcctatgttctgcctttggccaccacctctattccacatataattcatcattcttgtttgcctgcagactcttgcagtgccttgtaatatttacaatcttttcaggtttttgctggaaagaaaagtagtcttctaaagtttgaagatggtgaatagtgtactgctgtctccatgctgactgcagtaaccgggttatcatatatgttatgtatacattatgtatatataacatgtgtacatttaaaaatacagaaaaaagtgagcttgtgcagaaatggagaaaacaatgttattctcatcactgtggggttttattaaaattattttttcccatgacttacatgtttggttcagattatagtcactttgactgtaaatactggctagttttctatccagggcttttgcattatttcataattttgctaaatcatataatagtgctattttcatccttgtctgaggtacttttcctccccagaaataattaacttgaggtaaagctcagaaattcccttcttaacaaagagcctactatataaaaagggccttcctttccaaaaaacacacaaacctgtccttttcattttccttcttgtagaggagaaaatggttgtacttaaccatcctgcttgtaaagtttattcagaggatagtctgtatgtccagccaccatgtttacttctcaaagtgcaagtctgatgaatagtactgtatctccatatgtggtaatgtgagcatttcatcatgaagtacctgctgctatgtctgtgaagttgggtgtaacatcataagaatatgaaaccagtattggtgtaaatctaatgaaaataaccctatgtatatttgtagcagtcttgaatctctatttaaggtaatttgctgtaatataacaaatattcattctgtttttcatcccttccttgccagttttatatcaagcatgaattccaatggtttgacagcaaaattatctgtgaaagtttaaaaggcacttttctgctgtgatttttggattgagtgtggagtgttatgtacagtttgatgggatatatcattttagaaccccagatttaattctagtccaattaattttgtttaactacctcgttttcagtgctgttttgggtgcacaagtaaacactacctgtgaaacttgcttttttgccttgattctcagtattctttcagattataaatctggtctgcctcttttttcccagtgctagccaacagtttgagatgagagggatcatcactctcatctgtgtttaagtggagagccatgtgcttctgtgaaatatgctttggggatttgggggtggagagcagaagaataattgaaattggtggcaatataggatttaggtgtaggagttagttataaaataaacaaatggtaagaaagtacctgaattagacaatccagtgcctataactttgcattttttattagagatgcatttctcgtctgtgtgcctaaagggcaatgggttgaaattgctttaactaccacagcgaaatatttgacaaatccttcagcaatggcctatcattcaacatatattagcacagtgctaggtatttgcagtggtattttgttaccttaaaacggccaaatgcatttagttgaaatgtagttgatagtaagggttttatataactttatccaatctctaaagtttatggaagcattgactttcttctttgctgtcttttctgagtgatgaaaatgatgcattccttttttttccttgaaaactcagcaaatgtttgtaaccagatgttccttgtttcacatgtttactgtgtaacactacagcatatttaatattggtaaatactgtatttcagtcattatgcataagtacattcctgaggtatatttgccatcattttgggattcagttattttatcttctgtttgggtcagaaaaacttgaactatctgaggtggtatgcaggccattttctagaagattgttttttgaatctgtagtttatcaaggacttgttccccccctccctttgtttagaagaggaatcagaaaaggggggtggtgtgtagaaaaggcctttgatttgataggtgtaatttctaagattgaaattttaaaaatgcagatcgtaagatagtaacactcaaacttgataaaatcctttgaattgaaattagtatgaaatttttatggaaccaaatgccttcaggtcaccctggaaatagtctttgtatgtgaaagatcaacacaaacattggtcaggaaccctgacagccaatatatgaaggagcctgggatagtaactaggttacactaaagttattttcaactaagatagctagacgagtgtacaaaccaatagctcctattctggaaggttttctttttattaaaaaaaattcaaacaaggttaaaagtcaagcaagaagggaagagagaaactgggttctgagaaaaaaatgtgccagtataaaataaactcctaaatgcgtgcttgtcatcctctagtttttttttaagttgaatttcttttccactgtaacttaagatttgagattgaggtttgcggtccagaacataccctcagcagatacagtgactaactggaaagtgcagttgttcaaggtctgtcatgctcaatcacctaaagctataatttgtttgatatattaagcatgtagacctagtgcagcatgggagccactcaggaagtttatgcaattaataaactttcagcataatttactatgaagtatgcagaatttcaccctcttctccacacttaacatttagttgtatatgtgaactctcctttcttaattggggaatgtagcattatatagaatgttgttaaagttaattttaatcctttttgacattaacctttttttttttttggtaaaccaagtgatctgcctttcagcaactgtcttattttggttctttgaaactgtgatttttatttcatttgtacccaaccattgtaagtattttgttttgtttcctggaaattctgttttgaaacagaaaataaaggctgtgttaaatgagtatgttatcttattaaaatgctgccatagtcactgcaa

SEQ ID NO: 34468 - DNA, 715 bp, Homo sapiens
gggggcgggggagacatgccgtggctgttgcccccgcaacgtaactgggaggccagtatttgtaaatcggtgcttcgacttctaatcccaaagccggcaggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactgg

SEQ ID NO: 34469 - DNA, 4155 bp, Homo sapiens
gtccgtctgtcaggccgcctcctctccggccgtctgattttctacccttcggcgccctgctcttcctcatgttggcatccccggccacggagaccaccgtcctcatgtcccagactgaggccgacctggccctgcggcccccgcctcctcttggcaccgcggggcagccccgcctcgggccccctcctcgccgagcgcgccgcttctccgggaaggctgagccccggccgcgctcttctcgtctcagccgccgtagctcagtcgacttggggctgctgagctcttggtccctgccagcctcacccgctccggacccccccgatcctccggactccgctggtcctggccccgcgaggagcccaccgcctagctccaaagaaccccccgagggcacgtggaccgagggagcccctgtgaaggctgcggaagactccgcgcgtcccgagctcccggactctgcagtgggcccggggtccagggagccgctaagggtccctgaagctgtggccctagagcggcggcgggagcaggaagaaaaggaggacatggagacccaggctgtggcaacgtcccccgatggccgatacctcaagtttgacatcgagattggacgtggctccttcaagacggtgtatcgagggctagacaccgacaccacagtggaggtggcctggtgtgagctgcagactcggaaactgtctagagctgagcggcagcgcttctcagaggaggtggagatgctcaaggggctgcagcaccccaacatcgtccgcttctatgattcgtggaagtcggtgctgaggggccaggtttgcatcgtgctggtcaccgaactcatgacctcgggcacgctcaagacgtacctgaggcggttccgggagatgaagccgcgggtccttcagcgctggagccgccaaatcctgcggggacttcatttcctacactcccgggttcctcccatcctgcaccgggatctcaagtgcgacaatgtctttatcacgggacctactggctctgtcaaaatcggggacctgggcctggccacgctcaagcgcgcctcctttgccaagagtgtcatcgggaccccggaattcatggcccccgagatgtacgaggaaaagtacgatgaggccgtggacgtgtacgcgttcggcatgtgcatgctggagatggccacctctgagtacccgtactccgagtgccagaatgccgcgcaaatctaccgcaaggtcacttcgggcagaaagccgaacagcttccacaaggtgaagatacccgaggtgaaggagatcattgaaggctgcatccgcacggataagaacgagaggttcaccatccaggacctcctggcccacgccttcttccgcgaggagcgcggtgtgcacgtggaactagcggaggaggacgacggcgagaagccgggcctcaagctctggctgcgcatggaggacgcgcggcgcggggggcgcccacgggacaaccaggccatcgagttcctgttccagctgggccgggacgcggccgaggaggtggcacaggagatggtggctctgggcttggtctgtgaagccgattaccagccagtggcccgtgcagtacgtgaacgggttgctgccatccagcgaaagcgtgagaagctgcgtaaagcaagggaattggaggcactcccaccagagccaggacctccaccagcaactgtgcccatggcccccggtccccccagtgtcttcccccctgagcctgaggagccagaggcagaccagcaccagcccttccttttccgccacgccagctactcatctaccacttcggattgcgagactgatggctacctcagctcctccggcttcctggatgcctcagaccctgcccttcagccccctgggggggtgccatccagcctggctgagtcccatctctgcctgccctcggcttttgccctatccattccacgttctggccctggaagtgacttttcccccggggacagctatgcctcagatgcagcttcaggccttagcgatgtgggagaagggatgggacaaatgaggagacccccagggaggaatctccggcgcagaccccgatcccggctgcgggtcactagtgtctcagaccagaatgacagagtggttgagtgccagctacagacccataacagcaagatggtgaccttccgatttgatctggatggggacagcccggaagagattgcagctgccatggtatataacgagttcattctgccttcggagcgagatggatttctcagacggattcgggagattatccagcgagtggagaccctgttgaagagagacactggccccatggaggctgctgaagacaccctaagcccccaggaggagccagcaccattacctgccctgcccgtccccctcccagacccatccaatgaagagctccagagcagcacctccctggagcacaggagctggacagccttctccacctcctcatcttctcctggaactcctttgtctcctggaaacccattttcccctggaacccccatttccccaggtcccatcttccccatcacttctcccccatgtcatcccagcccctccccattctcccccatttcttcccaggtctcctcaaatccctctccacaccccaccagctctccacttccattctcctccagcacacccgagtttccggtcccactctctcagtgtccctggagttctctccccacgacttctccacctacgttctctcccacttgttctcaggtcactcttagttcccctttctttcctccgtgcccctccacttcttccttcccctccaccacagcagcccctctcctttctctggctagtgccttctcactggctgtgatgactgtggcccagtccctgctgtccccctcacctgggctcctttcccagtctcctccagcccctcctagtcccctccctagcctgccccttccccctcccgttgctcctggtggccaggaaagcccttcaccccacacagctgaggtggagagtgaggcctcaccacctcctgctcggcccctcccaggggaagccaggctggcgcccatctctgaagagggaaagccgcagcttgttgggcgtttccaagtgacttcatccaaggaaccggctgagcctcttcccttgcagccaacatcccccactctctctggttctccaaaaccttcaacccctcagctcacttcagagagctcagatacagaggacagtgctggaggcgggccagagaccagggaagctctggctgagagcgaccgtgcagctgagggtctgggggctggagttgaggaggaaggagatgatgggaaggaaccccaagttgggggcagcccccaacccctgagccatcccagcccagtgtggatgaactactcctacagcagcctgtgtttgagcagcgaggagtcagaaagcagtggggaagatgaggagttctgggctgagctgcagagtcttcggcagaagcacttgtcagaggtggaaacactacagacactacagaaaaaagaaattgaagatttgtacagccggctggggaagcagcccccaccgggtattgtggccccagctgctatgctgtccagccgccagcgccgcctctccaagggcagcttccccacctcccgccgcaacagcctacagcgctctgagcccccaggccctggcatcatgcgaaggaactctctgagtggcagcagcaccggctcccaggagcagcgggcaagcaagggggtgacattcgccggggatgttggcaggatgtgaattcagaacagaagccatgtatctcccccacaccagggcccaccatggagcttgtgttctcagaatctgatgctttctgatcaacaaaactgagcaaggaagatcccaacactgaaggggtagaaggccaggggggcatggagagtgcagctccattatagtgaagagccaaacatatgtgaactgtttgctgtgtggaggtgttagttctgctgcctaccatcttcatctctagcacctcccctgccaagagtcaaccactaagcaatcccacccaagcctggatgcttctagaggggcccactcccagctgggagagtgtaggggatatgctcacaccacattagcagcaacc

SEQ ID NO: 34470 - DNA, 2213 bp, Homo sapiens
cattcaagatgcaacacaaaagtatttcctctccgaagctctccctcatgcttggggcagttagtcatcccttcctgcgctcccacagcaccttggccgaggccctatctatcaatttacttcccaacccgtttggtaacgtcatgtctatccaccatgccccctgactcagtttctccctggggccgggcagacataggctaggagaatgctggcagaagatgcggaggcggcagcagggtgcggcaggggggaacttcccagtggggggctccttcccggaggacgtgtccccccaccaggactctggctatgcgccctcccccaggtacctgaggcggttccgggagatgaagccgcgggtccttcagcgctggagccgccaaatcctgcggggacttcatttcctacactcccgggttcctcccatcctgcaccgggatctcaagtgcgacaatgtctttatcacgggacctactggctctgtcaaaatcggggacctgggcctggccacgctcaagcgcgcctcctttgccaagagtgtcatcgggaccccggaattcatggcccccgagatgtacgaggaaaagtacgatgaggccgtggacgtgtacgcgttcggcatgtgcatgctggagatggccacctctgagtacccgtactccgagtgccagaatgccgcgcaaatctaccgcaaggtcacttcgggcagaaagccgaacagcttccacaaggtgaagatacccgaggtgaaggagatcattgaaggctgcatccgcacggataagaacgagaggttcaccatccaggacctcctggcccacgccttcttccgcgaggagcgcggtgtgcacgtggaactagcggaggaggacgacggcgagaagccgggcctcaagctctggctgcgcatggaggacgcgcggcgcggggggcgcccacgggacaaccaggccatcgagttcctgttccagctgggccgggacgcggccgaggaggtggcacaggagatggtggctctgggcttggtctgtgaagccgattaccagccagtggcccgtgcagtacgtgaacgggttgctgccatccagcgaaagcgtgagaagctgcgtaaagcaagggaattggaggcactcccaccagagccaggacctccaccagcaactgtgcccatggcccccggtccccccagtgtcttcccccctgagcctgaggagccagaggcagaccagcaccagcccttccttttccgccacgccagctactcatctaccacttcggattgcgagactgatggctacctcagctcctccggcttcctggatgcctcagaccctgcccttcagccccctgggggggtgccatccagcctggctgagtcccatctctgcctgccctcggcttttgccctatccattccacgttctggccctggaagtgacttttcccccggggacagctatgcctcagatgcagcttcaggccttagcgatgtgggagaagggatgggacaaatgaggagacccccagggaggaatctccggcgcagaccccgatcccggctgcgggtcactagtgtctcagaccagaatgacagagtggttgagtgccagctacagacccataacagcaagatggtgaccttccgatttgatctggatggggacagcccggaagagattgcagctgccatggtatataacgagttcattctgccttcggagcgagatggatttctcagacggattcgggagattatccagcgagtggagaccctgttgaagagagacactggccccatggaggctgctgaagacaccctaagcccccaggaggagccagcaccattacctgccctgcccgtccccctcccagacccatccaatgaagagctccagagcagcacctccctggagcacaggagctggacagccttctccacctcctcatcttctcctggaactcctttgtctcctggaaacccattttcccctggaacccccatttccccaggtcccatcgccctacagagggaaagccgcagcttctcacttcagagagctcagatacagaggacagtgctggaggcgggccagagaccagggaagctctggctgagagcgaccgtgcagctgagggtctgggggctggagttgaggaggaaggagatgatgggaaggaaccccaagttgggggcagcccccaacccctga

SEQ ID NO: 34471 - DNA, 1613 bp, Homo sapiens
gaactagcggaggaggacgacggcgagaagccgggcctcaagctctggctgcgcatggaggacgcgcggcgcggggggcgcccacgggacaaccaggccatcgagttcctgttccagctgggccgggacgcggccgaggaggtggcacaggagatggtggctctgggcttggtctgtgaagccgattaccagccagtggcccgtgcagtacgtgaacgggttgctgccatccagcgaaagcgtgagaagctgcgtaaagcaagggaattggaggcactcccaccagagccaggacctccaccagcaactgtgcccatggcccccggtccccccagtgtcttcccccctgagcctgaggagccagaggcagaccagcaccagcccttccttttccgccacgccagctactcatctaccacttgcttttgccctatccattccacgttctggccctggaagtgacttttcccccggggacagctatgcctcagatgcagcttcaggccttagcgatgtgggagaagggatgggacaaatgaggagacccccagggaggaatctccggcgcagaccccgatcccggctgcgggtcactagtgtctcagaccagaatgacagagtggttgagtgccagctacagacccataacagcaagatggtgaccttccgatttgatctggatggggacagcccggaagagattgcagctgccatggtatataacgagttcattctgccttcggagcgagatggatttctcagacggattcgggagattatccagcgagtggagaccctgttgaagagagacactggccccatggaggctgctgaagacaccctaagcccccaggtcagaccccttggtggacacttccaggggaaatggactctctgctccagggtttattactctctgccctcagcggtccccttggatttaactcctcttcatctctgggaccctaaaacagtggcgcttttttttttttttgagatggagtctcactctgtcgcccaggctggagtgcagtggcacgatctcggctcactgcaagctccgcctcccgggttcacgccattctcctgtcccagcctcccgagtagctgggactacaggcgctcgccaccacacccggctaattttttttgtatttttagtagagacagggtttcaccgtgttagccaggctggtctcgatctcctgacctcgtgatccgccctcctcggcctcccaaagtgctgggattacaggtgtgagccaccgtgcctggcctaaaacagtggctcttagcccatttgagaatatgatgaaagccatggactcttgttctagaaaacttgttcaatacatacttttcttttaactcattattttgaaataatttcagacttgtggagagaagttgcaagaattatataaagaaccactggataccctttgcccagatttgccacttgttagtgttttgccaccttagcgtcatcattgtctcttcctctcccctctgtatgtgtgcatacataatatatttttcggaaccacttaagagtaagttgcagacatcatgcccttttacctctatacatttcagcacatatgcttctgaat

SEQ ID NO: 34472 - DNA, 1205 bp, Homo sapiens
gtccaggcatgaggtggttcctgccctggacgctggcagcagtgacagcagcagccgccagcaccgtcctggccacggccctctctccagcccctacgaccatggactttaccccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttcttt

SEQ ID NO: 34473 - DNA, 1564 bp, Homo sapiens
atatctggtgctcctgatgggccggccagtctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggccctctctccagcccctacgaccatggactttaccccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacaggtggtcggtgtgggctgcgtcctggatggggtgcgctacaacaacggccagtccttccagcctaactgcaagtacaactgcacgtgcatcgacggcgcggtgggctgcacaccactgtgcctccgagtgcgccccccgcgtctctggtgcccccacccgcggcgcgtgagcatacctggccactgctgtgagcagtgggtatgtgaggacgacgccaagaggccacgcaagaccgcaccccgtgacacaggagccttcgatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttcttt

SEQ ID NO: 34474 - DNA, 630 bp, Homo sapiens
ccgagaggtggtcggatcctctgggctgctcggtcgatgcctgtgccactgacgtccaggcatgaggtggttcctgccctggacgctggcagcagtgacagcagcagccgccagcaccgtcctggccacgatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggc

SEQ ID NO: 34475 - DNA, 716 bp, Homo sapiens
ccgagaggtggtcggatcctctgggctgctcggtcgatgcctgtgccactgacgtccaggcatgaggtggttcctgccctggacgctggcagcagtgacagcagcagccgccagcaccgtcctggccacggccctctctccagcccctacgaccatggactttaccccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacgcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggc

SEQ ID NO: 34476 - DNA, 545 bp, Homo sapiens
ctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctga

SEQ ID NO: 34477 - DNA, 1403 bp, Homo sapiens
gtgtgtgtgtgtgtgtgagcgcgcgcgcgcgcgcgcgtgtgtactcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtga

SEQ ID NO: 34478 - DNA, 1518 bp, Homo sapiens
ggagaccttgggtcagctctgcaaaggggttgtttactgaatgcttctggtatctgcagccccgctggggttcggacagggggtctggaatagggcttcacaactacagcagggctaggaccctcttgggctggaaggagctggagaggcctctgcaagctgtcacaggctcttggtgctggcactggctcaggctttcacacacacacacgcgcacacacacacacacacacacacggacaggcacccccttggtggccttcacagtttcaccttcaggtaaatgggctcatcctttgagccatgaggatgggaagcgaagcaaggaatgaaaaagctagtgtgtttgtgtgtgtgtgtgtgtgtgtgtgtgtgtgtgagcgcgcgcgcgcgcgcgcgtgtgtactcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctctgtaagcaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtga

SEQ ID NO: 34479 - DNA, 1600 bp, Homo sapiens
ctgggccgcggctacccagagtcagggccacggagcttaggagaccttgggtcagctctgcaaaggggttgtttactgaatgcttctggtatctgcagccccgctggggttcggacagggggtctggaatagggcttcacaactacagcagggctaggaccctcttgggctggaaggagctggagaggcctctgcaagctgtcacaggctcttggtgctggcactggctcaggctttcacacacacacacgcgcacacacacacacacacacacacggacaggcacccccttggtggccttcacagtttcaccttcaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtga

SEQ ID NO: 34480 - DNA, 1235 bp, Homo sapiens
cctgagtcccgggaggaaagtgctcgcccattcctgacctgtgacacgctcactgcgaaggcaggttattagaagagtcccatgaaaggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagt

SEQ ID NO: 34481 - DNA, 2512 bp, Homo sapiens
gtggggtttgcagaggagacaggggagctttgtgtacccggagcaatgaacaagcggcgacttctctacccctcagggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaatggtggcaaatctactttgtttaaaacagtatgaatgcctattctcagatcactacatttaaggcattagaaacttttaaaaagttatcttaaaaatatacataaaatttgaacaacttaaaaattgaactaatttctaaaatatatcctataattatataatacacagacatttgttaccatctaagcattttgtatatgaaaaaattatgcaatttacaagaaaatattttacaaaataatctggaatacttgctaaagctgtataaaaagtatactaaattttaggctgggcgcagtggttcatgtctgtaatcccagcacttcgggaggccaaggtgggcagatcatttgaggtcaggagtttgagaccagcctggccaacatggtgaaaccctgtctgtaattaaaaaaatacaaaaattagccaagtgtggtggcatgcgcctgtaatcccagctactcgggaggctgagtcagaagaattgcttgaacccaggtggtggaggttgcagtgggtcaagattgcaccactgcactggcacggagaagcgagactcctttgggggagaaaaaaacatactcaatttaaaaaatttaatctatatttgacaatgtagcctaaggtgcccattagttgatacatcattatagggcaagtgaaattctagattaattcttgaacagaaataagattaagctgtaaatatatttagacttttcactgcctgatcttgaatatcagtttcttttggaaaggagaaaatgcaacttttctggccactgttaacaactgcaatctaaaattttttacatcaaatattgtaaaaagttaaatttccaagacaaagaccaagaacagtatcattactttgcaaaggaaagaaatataaagaatacaacttaaaattaacctgtggatctgaaatataaaatgttattaaaaataaattaatgttaaggctagaactgaagattatagtaaccggaacaattatagccatttattgcaaagtttggaagatatcaagcttagtaacattctgttcatttgcataaatgtcatgcagaacaataacaagtagcactgttgaaaaatatagacatttattataaaatcaattggtttgataagaaagcaattatttaaaaagtttaatacaaatacatgttaagtgtacaaattaggattcttttgggcaaacaagttgttatctaaagaagaagcaaaacctccttaacagttgtaataaaacctatgcctgaaaagttggtggctatt

SEQ ID NO: 34482 - DNA, 1062 bp, Homo sapiens
atgaagatatctaggggcagagtgtgcttggagtcagagaacaaggacgctggtgtggctggtcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcatgtaagtctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaa

SEQ ID NO: 34483 - DNA, 1417 bp, Homo sapiens
cctcctgagtcccgggaggaaagtgctcgcccattcctgacctgtgacacgctcactgcgaaggcaggttattagaagagtcccatgaaagtaaacagggtattaaaacggatccttaaaaatgaaagtgcaggctgaaagttggtagtgtgggaggtagagggtgtgtgttcttgtgcagaggagcgtggggtttgcagaggagacaggggagctttgtgtacccggagcaatgaacaagcggcgacttctctacccctcagggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaa

SEQ ID NO: 34484 - DNA, 1089 bp, Homo sapiens
acatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagt

SEQ ID NO: 34485 - DNA, 953 bp, Homo sapiens
tgtgggaggtagagggtgtgtgcatgtaagtgtcttcttctggacctgctggaaaagattgagtctagacagaatttttttttcctgcaattgttagcttggagtgatcagcttagtttggctaaatatgagaccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagatgtgtgccaagcttctaatctgcttcctgcattgaggtctttaaactgttgtctaccttccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtca

SEQ ID NO: 34486 - DNA, 2748 bp, Homo sapiens
ctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcccactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtgggttttaaaaaatgtttgctaaactacccaagtaagatttactgtattaaatggccttcgggtctgaaaagcttttttaacttcttgcttaaaatgcgttttattttgataagatacttcaaatagcctccaaaagtgtagatccaatcatttaaataaacctgtatgtatatgcatatgtgtacatgcatatcccctcctgctaaaactcata

SEQ ID NO: 34487 - DNA, 2037 bp, Homo sapiens
gtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattctttgagtattg

SEQ ID NO: 34488 - DNA, 2332 bp, Homo sapiens
tccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattggagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcccactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtgggttttaaaaaatgtttgctaaactacccaagtaagatttactgtattaaatggccttcgggtctgaaaagcttttttaa

SEQ ID NO: 34489 - DNA, 2095 bp, Homo sapiens
ggcggcgtcatgtgatccgcttccctgctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattctttgagtattgtcttacttctctta

SEQ ID NO: 34490 - DNA, 2666 bp, Homo sapiens
cagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcatggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccag

SEQ ID NO: 34491 - DNA, 7534 bp, Homo sapiens
tggtcttgaactcctgaccttgtgatccgctcgcctcagcctcccaaagtgctgggattacaggcatgagccaccgtgcctgtcctagaaccactggtaactcttaactgtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaactt

SEQ ID NO: 34492 - DNA, 7706 bp, Homo sapiens
tggtcttgaactcctgaccttgtgatccgctcgcctcagcctcccaaagtgctgggattacaggcatgagccaccgtgcctgtcctagaaccactggtaactcttaactgctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 34493 - DNA, 7827 bp, Homo sapiens
gcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaactta

SEQ ID NO: 34494 - DNA, 8390 bp, Homo sapiens
tgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataactaatcaaggccatttaatccgtcacattcatctcataatagaaacacgttcatattccagtggtcaatgtagatttcaagttgaaaggcagtccctttagttgggggctgtccagagctgcagcagggctttgcacggaaggggtggccctgttagagttgcttctcctctagtttgtaacttactggacttttgtggaaaatatcagcgtcgctaccctcagaaacaaactaacagcacacgttaggaggagtcctcatcagctgttctcattgccagtgagatatattcagtattgtagatactacactaatttccaacataagaggcaggaagagttttgattctatccttttttactaaacagttttattatgacactagatacagtaaatttttagaaaaaaataccatttacagtattattgtgaaccatttaacccttttgatccaaggccccggaccaaggggatactgtaatcaggttatgtacaccaacctctgcatcagttgcttctatagagcatcagccctcatgtttcattgtcttaatgtcggggagcagcctggtgtcctgccccaggtgtccgcatttttgcatggtaaggaaaaggcttacttgcccttcagctcataaaagcagaaggtgtgctattcacagtaccatgcgagtagcccacagttaattcccggcagattctttggctgtgttttatctttaatgaacgtttctgactaatattttgttgtaaaccattaagtaatgtaacgcatgtaagatgcttagggtgcctggccaggactccgtggtttcctgttgtgacagtaataatggttataataataaaaatgataaaattgccatcattctatttttatccaaaagtataaattttgctttggcatgaaaagtggtcctcttgactgcattatgcatgcgaggatgaaataaacctagaagtggcagaacactggatttgtgtgtgtggcgctttagggtgctggactgtatggctgagggctggttgggttcctctattggctctgctcaaatgttgcaggatacatagccccaaagatggtctaggagcaatctaagctgtgttactccaaaggacatgaaaaagctcaagagtaaaattaaaattctcaaaaaaaaaccccacgaaatttaaagatggggaaaaaaagatggtataaaaatggctctggttcaataagcagtcacccaaagtaaagactctatcttgaaaggcttttggtgaaaatgaagggatttcatttgaaattacagcatgatgaattttgcatgggtggccagccagctagcccataactgatagatgcattagaagtcagccagcgcataggtgctccctctatattatggagaaagcaaaaccctgcaaatgaccaaatggtgtccaaagagcagcatgacattggcatcagctgaataaccaggggcacatgggggaacgtggatgggaatgatagtgtatctcagcggggggtggggtgacatcgttccctggggacattgggaaggtgggcaggggcaagtgaactcagcactctgcagtgagagggacagtcccatgtgtggcagcattgtcccacttcagatgccaggagtgggctcatcctagaggagcggagttttccgagaggaccatctcctggtttcctgaaggaggtgggtggaaacggctcttgtttgaaagaacttagggaggaccattggcttgccaagagtacagaaattcattatgctgctaatttaacgtggaattccttcatttcataagaacctcaaaataatggtgatacattctagccttaagacatttgaattgccggttgttgaggtgaattttgtttgtcatacatggaaccattttagtcccatttgactcacttcagaccatcttccacacactatgtctgtgcttggagaggggaggtggctctccagtgtaaaacttgaggcattcactagaggtgaaaacttgtcagaatatataaaagcttagattgtagctgttctaaaaacgtaagtactccattgtaatagggtggcatcttcaggtagtgcacatattggcaatagaggtcctgaattgtttttctaagactgatctgagagccattgggccatcaagcctttatatatctgcttctaaaattgccccacctgctctagatggatctttgggcctttcctcagtgttcatgcaaaaattaaatgtcttttttcagcatactgactccaggtgtagttacatctcagtgctgtcttgagtatatattttatctcttatacctgtatctcccaactagaaacagctccagtgtttttaagagaatgtttcttaaaaccaataggaaacttaagcgaggtttcatgacacaacctttcatgtcgtgaaaggcagagggtgactgtgtgtgatgtgcagagtccttggacaggagtcgggggctcctctgtcccactgctgcttcttgagtgggtggagtggtgcttagaggatctccgagaggtccccgcagctctagggagatctgattttgtgttttttgtttaagtacttcacacagaagcctaggtagatttaaaatggggtgctcagggactggggaacaagacggggtggggtggggagatgggcatttggagagtctcatgtagctggagacgttaagagctgagcacaccacaggaaaggagggaggatgctgtgtgagagccatgctgtcaggagcaagcttgctgctcctgtgctgccctggccctggccttgcttgcccatggtgtgtgtgtccagaggtgtgtgtgaggctgccagaacaagtgctgggtctgtcacagagaagtttaaaaaagaaaactaagattataaattagcatctagttccaaaaccaaaaaaagtgcctgtggatgtatataaaattaagatgataagaaagtgctcctgagaaggctcttgccagaagcctgatgtgagtgtgtggcacctgtgatggcagggctgtgagctgggcttctgtcctcctctgtgtcccggcatggaagccagtataagcatttccaaatgagggaaaagtccttggctcgtttgatccagttgagttgaaagggttgccttggcagcagaggctcctctgatggctgacatcagtcactgcgtctgggcctgagacgtgcatggagggctgtaaagccacggattcccctcgctggagaggctcctgtctgatagcggtagatgaaaaataaggtcgttatgactttggcaacttgcttcatttctttttcatttgacttacaacacacttctctaacatctagcccttttaaatttttaattaatttcaaagcttcctctggccaggtagacttttgtatacagaccaggtgagagcccttttgccttagtgtgaaaatgtaacattttatgcttttaaaatcaatagattcatcaccttagttttttaaaaaaaatctataaatagggtaattgctgaggtgtgcggtttatctttgagatgataaagctaaattatagtcttttgccagagaaactgaggtaactgtcattagaaaaggtttcttaaaatactcacaaagctgttattggcttcttaacttctaaaatttggggggtcttgcatttatttattatttatttatttatttatttagagacagagtctcaccctgttggccaggctggagtgcagtaagtggcacaatctcggctcactgcaacctccgcctccttggttccagcaattcttctgcctcagcctcccgagtagctgggactacaagcggctgccaccacacctggctatttttttttgtatttttagtagagacagggtttcgccatattggccaggctggtcttgaactcctgacctcgtgatccacccgcctcaccctcccaaaatgctgggattacaggcgtaagccactgcacctggcggggtcttgcttattttaaaagaaatattctgattcatattttaggactttttgtcaacgaaattggttttgatccctttgggtaccatttttattgttttatgtagaatgttagaaattaccactaatttacctggcagtgatgtcaaattgactgtaattagcaggtagaaaattatttgtattatattcatctgattcctatactggatgagcaaggagcatgcttcctttgggacattcttacagcagggtgtctctccaacagcccgacaggcctcatctttttggttggatacctttgaactccatggttacgtgttaggtccacatttgtgtttttttctagcctacctatagttgttggcctttttgcatataactctcgggtaatattttgaagcatgctgaccatccaggcatatagtattttcaagaaatgactgaggtaggggtgggggtcctggtccggctgatgggggtttgctcagcactgtgccagtggaagcaggtgtattgtgggcagttttgtcattgtcctcaagtccttcgcagacagtgcacagcctgctgtctgcagtcggccagaccaggctcctccccagcacactccctgtgggatggccgctgctcaggacacagtgggacaaagttgggttgataggatattttagattcattttacctttgacaagggcaggccttgaattgggagcagcagccacctggcctcactctggccacaggtgacacttggtccttgctgccacctgcttggggctatgtggctacggctacacaaaagcctgtgcaggttagaagacgactgtggtgtgcagtggtgctctgggagtggagacttcctctgttctcagagactcacccccagccctgaccctagaatttagggatagccaggaagtttctagtttgtgtaacctagaagggtcactttaataaaaattgttatgaactatagtattttagatgatgagtgacttattttaattccactttaacattttactgtgctgttaacttggaagacctgtttgaaattagtcttgatttcacactcatttaatctgctgagcacagggctgttgtcatttgtaaacgcaaacactgtggaggtacttctcgccatcagcttccttctttacaaaaccatcatttcaacatgaaaattatgtcagtttatagaaatatttattgttcaaggtctgtaattgtatttcaaaaacgatgtcgtattcaagttgtgaagggatttgttttgtcaaaaaattaaaaactcaatgtgtatgacgccactctgaagagtaggtgagcgctttgcagtcacagaaggtggcatctgactgcggctcatacaggtcaccctgaagggccacgtgcttttagcagttggctggaatgtgttcactaggttccgttatgtttggtaatatcatcttgaaaagtccctgtaatagatcaaggagactgcattccctgccctgaaggaatgtatttctaaggcaaataggcaacttggtactatcttattctgagtagagagtggagaaagtattttcagactgaagaaaactttgaaaagtcaggagctaagctgctcggagctcagtgccgcagcatggctgtggtggacgcgggaaacaacgggaaagttcttgacagagtctgtgtccgctcagtccctgcacttttcctttccaaatgcatctcgttggatatggaatagatcgtagatgttgtagactgagatttgggactatgttgggaccgtacaggtgaatgtgccacctccacaaatggcttctccgagtgagtcacgtcacctggtgcgtggaggtggagcctgcggctggagtaaggcttgctgtgggacgccctcgtactttgctctccttgcgggtggttgccgagccgagagcattggatcctccccgactgtggctagttgtctgtccggtggctgggagggggtgtggtgggaaaaagtcggaatctctgcaatctgtgtcatggactgtactattgtaaggtctatattctgtatgtgggtcccagaccctgatcaggaaatgagcctcatgtgtgtcgttaacatttatatatttccattcaaaatatgtattcagtgtttatttcctcaaaacagactttgttaatgtaggaaatctctccaagtggaaacgtgctaactttttctgtaaatctgaaataaaaggtgctgttccttcctctg

SEQ ID NO: 34495 - DNA, 5109 bp, Homo sapiens
gcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataac

SEQ ID NO: 34496 - DNA, 1316 bp, Homo sapiens
tggtcttgaactcctgaccttgtgatccgctcgcctcagcctcccaaagtgctgggattacaggcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtattttcaaatcaaagaagtttgaacacttaaaaacaagtcaaattgtactgaaagattaa

SEQ ID NO: 34497 - DNA, 8568 bp, Homo sapiens
cagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataactaatcaaggccatttaatccgtcacattcatctcataatagaaacacgttcatattccagtggtcaatgtagatttcaagttgaaaggcagtccctttagttgggggctgtccagagctgcagcagggctttgcacggaaggggtggccctgttagagttgcttctcctctagtttgtaacttactggacttttgtggaaaatatcagcgtcgctaccctcagaaacaaactaacagcacacgttaggaggagtcctcatcagctgttctcattgccagtgagatatattcagtattgtagatactacactaatttccaacataagaggcaggaagagttttgattctatccttttttactaaacagttttattatgacactagatacagtaaatttttagaaaaaaataccatttacagtattattgtgaaccatttaacccttttgatccaaggccccggaccaaggggatactgtaatcaggttatgtacaccaacctctgcatcagttgcttctatagagcatcagccctcatgtttcattgtcttaatgtcggggagcagcctggtgtcctgccccaggtgtccgcatttttgcatggtaaggaaaaggcttacttgcccttcagctcataaaagcagaaggtgtgctattcacagtaccatgcgagtagcccacagttaattcccggcagattctttggctgtgttttatctttaatgaacgtttctgactaatattttgttgtaaaccattaagtaatgtaacgcatgtaagatgcttagggtgcctggccaggactccgtggtttcctgttgtgacagtaataatggttataataataaaaatgataaaattgccatcattctatttttatccaaaagtataaattttgctttggcatgaaaagtggtcctcttgactgcattatgcatgcgaggatgaaataaacctagaagtggcagaacactggatttgtgtgtgtggcgctttagggtgctggactgtatggctgagggctggttgggttcctctattggctctgctcaaatgttgcaggatacatagccccaaagatggtctaggagcaatctaagctgtgttactccaaaggacatgaaaaagctcaagagtaaaattaaaattctcaaaaaaaaaccccacgaaatttaaagatggggaaaaaaagatggtataaaaatggctctggttcaataagcagtcacccaaagtaaagactctatcttgaaaggcttttggtgaaaatgaagggatttcatttgaaattacagcatgatgaattttgcatgggtggccagccagctagcccataactgatagatgcattagaagtcagccagcgcataggtgctccctctatattatggagaaagcaaaaccctgcaaatgaccaaatggtgtccaaagagcagcatgacattggcatcagctgaataaccaggggcacatgggggaacgtggatgggaatgatagtgtatctcagcggggggtggggtgacatcgttccctggggacattgggaaggtgggcaggggcaagtgaactcagcactctgcagtgagagggacagtcccatgtgtggcagcattgtcccacttcagatgccaggagtgggctcatcctagaggagcggagttttccgagaggaccatctcctggtttcctgaaggaggtgggtggaaacggctcttgtttgaaagaacttagggaggaccattggcttgccaagagtacagaaattcattatgctgctaatttaacgtggaattccttcatttcataagaacctcaaaataatggtgatacattctagccttaagacatttgaattgccggttgttgaggtgaattttgtttgtcatacatggaaccattttagtcccatttgactcacttcagaccatcttccacacactatgtctgtgcttggagaggggaggtggctctccagtgtaaaacttgaggcattcactagaggtgaaaacttgtcagaatatataaaagcttagattgtagctgttctaaaaacgtaagtactccattgtaatagggtggcatcttcaggtagtgcacatattggcaatagaggtcctgaattgtttttctaagactgatctgagagccattgggccatcaagcctttatatatctgcttctaaaattgccccacctgctctagatggatctttgggcctttcctcagtgttcatgcaaaaattaaatgtcttttttcagcatactgactccaggtgtagttacatctcagtgctgtcttgagtatatattttatctcttatacctgtatctcccaactagaaacagctccagtgtttttaagagaatgtttcttaaaaccaataggaaacttaagcgaggtttcatgacacaacctttcatgtcgtgaaaggcagagggtgactgtgtgtgatgtgcagagtccttggacaggagtcgggggctcctctgtcccactgctgcttcttgagtgggtggagtggtgcttagaggatctccgagaggtccccgcagctctagggagatctgattttgtgttttttgtttaagtacttcacacagaagcctaggtagatttaaaatggggtgctcagggactggggaacaagacggggtggggtggggagatgggcatttggagagtctcatgtagctggagacgttaagagctgagcacaccacaggaaaggagggaggatgctgtgtgagagccatgctgtcaggagcaagcttgctgctcctgtgctgccctggccctggccttgcttgcccatggtgtgtgtgtccagaggtgtgtgtgaggctgccagaacaagtgctgggtctgtcacagagaagtttaaaaaagaaaactaagattataaattagcatctagttccaaaaccaaaaaaagtgcctgtggatgtatataaaattaagatgataagaaagtgctcctgagaaggctcttgccagaagcctgatgtgagtgtgtggcacctgtgatggcagggctgtgagctgggcttctgtcctcctctgtgtcccggcatggaagccagtataagcatttccaaatgagggaaaagtccttggctcgtttgatccagttgagttgaaagggttgccttggcagcagaggctcctctgatggctgacatcagtcactgcgtctgggcctgagacgtgcatggagggctgtaaagccacggattcccctcgctggagaggctcctgtctgatagcggtagatgaaaaataaggtcgttatgactttggcaacttgcttcatttctttttcatttgacttacaacacacttctctaacatctagcccttttaaatttttaattaatttcaaagcttcctctggccaggtagacttttgtatacagaccaggtgagagcccttttgccttagtgtgaaaatgtaacattttatgcttttaaaatcaatagattcatcaccttagttttttaaaaaaaatctataaatagggtaattgctgaggtgtgcggtttatctttgagatgataaagctaaattatagtcttttgccagagaaactgaggtaactgtcattagaaaaggtttcttaaaatactcacaaagctgttattggcttcttaacttctaaaatttggggggtcttgcatttatttattatttatttatttatttatttagagacagagtctcaccctgttggccaggctggagtgcagtaagtggcacaatctcggctcactgcaacctccgcctccttggttccagcaattcttctgcctcagcctcccgagtagctgggactacaagcggctgccaccacacctggctatttttttttgtatttttagtagagacagggtttcgccatattggccaggctggtcttgaactcctgacctcgtgatccacccgcctcaccctcccaaaatgctgggattacaggcgtaagccactgcacctggcggggtcttgcttattttaaaagaaatattctgattcatattttaggactttttgtcaacgaaattggttttgatccctttgggtaccatttttattgttttatgtagaatgttagaaattaccactaatttacctggcagtgatgtcaaattgactgtaattagcaggtagaaaattatttgtattatattcatctgattcctatactggatgagcaaggagcatgcttcctttgggacattcttacagcagggtgtctctccaacagcccgacaggcctcatctttttggttggatacctttgaactccatggttacgtgttaggtccacatttgtgtttttttctagcctacctatagttgttggcctttttgcatataactctcgggtaatattttgaagcatgctgaccatccaggcatatagtattttcaagaaatgactgaggtaggggtgggggtcctggtccggctgatgggggtttgctcagcactgtgccagtggaagcaggtgtattgtgggcagttttgtcattgtcctcaagtccttcgcagacagtgcacagcctgctgtctgcagtcggccagaccaggctcctccccagcacactccctgtgggatggccgctgctcaggacacagtgggacaaagttgggttgataggatattttagattcattttacctttgacaagggcaggccttgaattgggagcagcagccacctggcctcactctggccacaggtgacacttggtccttgctgccacctgcttggggctatgtggctacggctacacaaaagcctgtgcaggttagaagacgactgtggtgtgcagtggtgctctgggagtggagacttcctctgttctcagagactcacccccagccctgaccctagaatttagggatagccaggaagtttctagtttgtgtaacctagaagggtcactttaataaaaattgttatgaactatagtattttagatgatgagtgacttattttaattccactttaacattttactgtgctgttaacttggaagacctgtttgaaattagtcttgatttcacactcatttaatctgctgagcacagggctgttgtcatttgtaaacgcaaacactgtggaggtacttctcgccatcagcttccttctttacaaaaccatcatttcaacatgaaaattatgtcagtttatagaaatatttattgttcaaggtctgtaattgtatttcaaaaacgatgtcgtattcaagttgtgaagggatttgttttgtcaaaaaattaaaaactcaatgtgtatgacgccactctgaagagtaggtgagcgctttgcagtcacagaaggtggcatctgactgcggctcatacaggtcaccctgaagggccacgtgcttttagcagttggctggaatgtgttcactaggttccgttatgtttggtaatatcatcttgaaaagtccctgtaatagatcaaggagactgcattccctgccctgaaggaatgtatttctaaggcaaataggcaacttggtactatcttattctgagtagagagtggagaaagtattttcagactgaagaaaactttgaaaagtcaggagctaagctgctcggagctcagtgccgcagcatggctgtggtggacgcgggaaacaacgggaaagttcttgacagagtctgtgtccgctcagtccctgcacttttcctttccaaatgcatctcgttggatatggaatagatcgtagatgttgtagactgagatttgggactatgttgggaccgtacaggtgaatgtgccacctccacaaatggcttctccgagtgagtcacgtcacctggtgcgtggaggtggagcctgcggctggagtaaggcttgctgtgggacgccctcgtactttgctctccttgcgggtggttgccgagccgagagcattggatcctccccgactgtggctagttgtctgtccggtggctgggagggggtgtggtgggaaaaagtcggaatctctgcaatctgtgtcatggactgtactattgtaaggtctatattctgtatgtgggtcccagaccctgatcaggaaatgagcctcatgtgtgtcgttaacatttatatatttccattcaaaatatgtattcagtgtttatttcctcaaaacagactttgttaatgtaggaaatctctccaagtggaaacgtgctaactttttctgtaaatctgaaataaaaggtgctgttccttcctctg

SEQ ID NO: 34498 - DNA, 528 bp, Homo sapiens
gccgccgccgccgccccctccccgcctgggccctaccgccgcacggccccggccccctcccagcctgccgctccggagagccgcccgccgaggatgcgacgcaccgcagagatgggtctcgccatcaccatgttgcccagtctggtctccaactcctgggctcaagcgatcctcctgccttggtctcccaaagtgctgggattacagagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagct

SEQ ID NO: 34499 - DNA, 4251 bp, Homo sapiens
cgctgcgcccgccgccgccgccgccccctccccgcctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgcca

SEQ ID NO: 34500 - DNA, 1212 bp, Homo sapiens
accatagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaa

SEQ ID NO: 34501 - DNA, 3964 bp, Homo sapiens
gggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaa

SEQ ID NO: 34502 - DNA, 816 bp, Homo sapiens
ggtcttgctcccttgcgcaggcgagagtacagtggcacgatcatagctcactgtagcctccaactcctgggctcaagcagtcctcctacttcaggctaccaaagtgctgggattacaggtgtgagcgtgagccactacacctggctaatttttgttggctgtttttaatctaccacacttttatagcaagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaag

SEQ ID NO: 34503 - DNA, 3995 bp, Homo sapiens
gggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 34504 - DNA, 5431 bp, Homo sapiens
gggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagagggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgtaactaatttttatatgttaactgttaccaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaa

SEQ ID NO: 34505 - DNA, 5273 bp, Homo sapiens
agaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgtaactaatttttatatgttaactgttaccaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaatctggcctcttgaaaa

SEQ ID NO: 34506 - DNA, 4724 bp, Homo sapiens
atggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagagggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgtaactaatttttatatgttaactgttaccaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaa

SEQ ID NO: 34507 - DNA, 4471 bp, Homo sapiens
tgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagagggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatc

SEQ ID NO: 34508 - DNA, 1032 bp, Homo sapiens
gtagtgctaggaagggctgaggagggaacgacggggagggggcgacctagggatggagcgccagaccccaggaggaatggaaggggaagcgggtggcctgaaagggctcgaggggagtcctgacggaggagcagatggcaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatcct

SEQ ID NO: 34509 - DNA, 577 bp, Homo sapiens
cagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaagggatgctcctgaaactgaagacaaccaagcccgatgagagaaagggaaagttaaggatgctggagcagaacaatggatttctctttctctttcatgcaagggatcatgggaaacacaattcagcaaccacctcaactcattgactccg

SEQ ID NO: 34510 - DNA, 301 bp, Homo sapiens
ttccttttcctctccgacatcagtatgaatctggaaggggccaattcagactgttagccccctttctttctattcatgaactcttttccccttacgtcttgggtcattttaaattattcataaccgccaaaggaggtagtgatgttttccatcactacctttttgatgcttttctccctctctttaccctcttccttctggttgcaaacaaggcccgatgagagaaagggaaagttaaggatgctggagcagaacaatggatttctctttctctttcatgcaagggatcatgggaaacaca

SEQ ID NO: 34511 - DNA, 3343 bp, Homo sapiens
gtgacttccgcaggactgccaagttcaagccgccagggccagggcactgctagcagctgggctgagccctgttctcccggcgttcccaccgcccagtggcaatagctgtgaacggcggcaggagcatggcagtggaacaataaggaaaagatcttttaaaaaaaagatataatacagaagccaagcaaggcggccccgacctgtaaccccagcactctgggaggcagaggcgggcgggcggatcgcttgagcccaggagtttgagaccagcctggccaacataggaaggcctcgtcaaaaagacaaaagggtaaaacgaatttaataaaatgaagtttaacttttactcatgtttgtatctaatgacaagcttttaaaactgaaaagttcactactggctcctgcctggcggctccagcccgactgggggccggggcctccctgcactgtggggtcacgagtgcccctggacagctcccgagcgccctccgacccgcatgctcagcgcagccccgtcggcggcgcgccacgggcagagcgggctcagcgggggacggaagctcagcgctgcgaccgggatcccgcaggctcgctccgcagggccgcggctcctctccgtgcaggtgctgggcccgcgggggcggggcgtccacacggtccgcgccgagacccaagcggggaaaaagcgaagagcggacagcggggcaggtgccacagggagcctccgccccaccgcgcgagcagcaagtctgcggcgcttgacacctgcactgcgaatgccaggccgcagcccgggctcccaagacgcgaatacgcgcgcctgctcgtgacgtcattttttgcggtcttcccgagagccagcagagggcgccgccatgatgttttacggaagccgatagtccttgctcagcggcaccccgtccttccggctctcggctttgccacaaagcttcccgaagacgcggccgctacccggagacgcggtcgccacccagaagcgctctcccgggaagccccgctcgtgggaccgcgccacctgcgccgcctctgcggcccgcagcccgacgggcgccgccatgttggggtcctagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 34512 - DNA, 3038 bp, Homo sapiens
gtgacttccgcaggactgccaagttcaagccgccagggccagggcactgctagcagctgggctgagccctgttctcccggcgttcccaccgcccagtggcaatagctgtgaacggcggcaggagcatggcagtggaacaataaggaaaagatcttttaaaaaaaagatataatacagaagccaagcaaggcggccccgacctgtaaccccagcactctgggaggcagaggcgggcgggcggatcgcttgagcccaggagtttgagaccagcctggccaacataggaaggcctcgtcaaaaagacaaaagggtaaaacgaatttaataaaatgaagtttaacttttactcatgtttgtatctaatgacaagcttttaaaactgaaaagttcactactggctcctgcctggcggctccagcccgactgggggccggggcctccctgcactgtggggtcacgagtgcccctggacagctcccgagcgccctccgacccgcatgctcagcgcagccccgtcggcggcgcgccacgggcagagcgggctcagcgggggacggaagctcagcgctgcgaccgggatcccgcaggctcgctccgcagggccgcggctcctctccgtgcaggtgctgggcccgcgggggcggggcgtccacacggtccgcgccgagacccaagcggggaaaaagcgaagagcggacagcggggcaggtgccacagggagcctccgccccaccgcgcgagcagcaagtctgcggcgcttgacacctgcactgcgaatgccaggccgcagcccgggctcccaagacgcgaatacgcgcgcctgctcgtgacgtcattttttgcggtcttcccgagagccagcagagggcgccgccatgatgttttacggaagccgatagtccttgctcagcggcaccccgtccttccggctctcggctttgccacaaagcttcccgaagacgcggccgctacccggagacgcggtcgccacccagaagcgctctcccgggaagccccgctcgtgggaccgcgccacctgcgccgcctctgcggcccgcagcccgacgggcgccgccatgttggggtcctagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgac

SEQ ID NO: 34513 - DNA, 2012 bp, Homo sapiens
cccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttct

SEQ ID NO: 34514 - DNA, 3640 bp, Homo sapiens
gtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggtcaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaacgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggcggctgtgggggaggtccctgccagtgtttagaagagcctgactgtgttcagtgccttggagcagaaagccagggtcctgagtggctgaaataaaagcctctggtggaacctgca

SEQ ID NO: 34515 - DNA, 3255 bp, Homo sapiens
cgtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggtcaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaacgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctcca

SEQ ID NO: 34516 - DNA, 1625 bp, Homo sapiens
agattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctg

SEQ ID NO: 34517 - DNA, 7130 bp, Homo sapiens
ggggcagcgcggttacctgcaccgcccgagccgcacctggcggaggcagaagtcacaaacccggcgagctcagagcggtggagcggagaggagggacggcacccggctgcagggaggagggaggcggcagcggcagcggcggcgtggagggcgcagcgcgccgcgcggcggaggagggcagacggcggcggcggcggcgctcggctcgctctgcccggccggctgggcgcgcacccgggctcgcaccgcgccgctgcggacgcacatggcagcgtgagaggccggcggcgggaggagcgggcggcgccgggtcggggctgcagggccgcatggacagcggcgccaccccggccggcccctactagggccccccatctgcgggcgccaccccccggatcatggtgcctcggcggccgcccgggctaagagcggccggctggagccgctgagcccccgctgcggccgggagctgcatgggggagcgccggcagcgcttgggaagatgccccggccggagctgcccctgccggagggctgggaggaggcgcgcgacttcgacggcaaggtctactacatagaccacacgaaccgcaccaccagctggatcgacccgcgggacaggtacaccaaaccgctcacctttgctgactgcattagtgatgagttgccgctaggatgggaagaggcatatgacccacaggttggagattacttcatagaccacaacaccaaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagcttggtctctggttcatcatccagctccaagtatgaccctgagatcctgaaagctgaaattgccactgcaaaatcccgggtcaacaagctgaagagagagatggttcacctccagcacgagctgcagttcaaagagcgtggctttcagaccctgaagaaaatcgataagaaaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctcccctttccagtcatttctttcccacccatccgcagtcctggaaacatttattttttcttttgcccactgttttcatttgctcattaaattaaaatgactgctcggctcattgggaatccacatccccaagttagactggggatatgctctctgtactgtctccttctatggaattccaccccacccagagagagatgacttcacagtttgttcatatgagcatcatcccatgtcgtccccaacccaggggctggtaggtgctacagcttgtgcttcatgctgctcctgtggcccctattcctacccagctcagagctttgcagggtctactgcagacaatcagaagtcagtttctaacaaatagcaacagccacaaatctcttcctccttcctctctgacattaccctgtgcaacttttctcaaagtctgttgcaccactcagcaaagcaagttgcaccagctatatcagaatcacctggggcagcctattaaaaatgcagactgttgagaccatcctggctaacacggtgaaaccctgtctctactaaaaatacaaaaaattagccggccgtggtggcgggcagctactcgggaggctgaggcaggagaatgacctgaacctgggaggcagagcttgcagtgagctgagattgtgccactgcactccagcctgggtgacagagcaagactccgtctcaaaaaaaaaaaaaaaagaaaaatgcagactggctggcgcggtggctcatgcttgtaatcccagcactttgggaggctgaggcgggcagatcaactgagatcgggggttcgagaccagcctgatcaacatggagaaacctggtctctactaaaaatacataattagctgggcgtagtggcgcatacctgtaatcccagctacttgggtggccaaggcttgaacccaggaggcggaggttgcggtgagccgagatggcgccattgactccagcctgggcaacaagagcgtaactccatctcaaaaaaataataataataaaaataaaatgcagactgtcaggtcctctctagacccactgaactatcccgcccaccctgggacggtccccagtgccagtgttttacccatgttccctctgtaagtcttatgcacaccgcaatttgagagccccactggtataaagtgagtgaaacccaggcagagacaggcaaaatggtgaggcccgcatcctattggtgagtcacacagggaacgctgaaattcatggccttctccaggctactgggaacccatgggcggtgatggagggagtggtgccaccttcacttgctgctgaggctcttccccctctccccagcatactccttacctggctgtctctcctcatgtataaggaacctatagtggtgtagaatctactcttcttccccctgtggcttccaggcccccctgtatagctgctatccagcccgatttctcaccactggcccagggcttcctcctgccccgtggcttcacgtctctgaacacatcaatctctgatgttctctctccttccattgaattccaccagacacattcagggtttacttcgtaatgtcttcatatgagtatcaatcaacaccttccccaactcaattgtactaggttgtagagcacaaggatggtctcgtgctgctctgtggcacctgtgcctacactcctctgagctttgaggaggctgctctctttgctgaccccatgatcttttctgcccttctgttaagggcattggccacagcaacggggcaaatgccccaagctggctgtaagtgacccatccctttggctcccatgattagaccaaggagaggcatggggtccagctgagccattcagaaccattccttagcattttccactcaaaggttagagatgagattttctcttcccaaggctacctctggccatggttccagcttcatgggggcaatgggattaggaaaatgaggtcaacctgcaaaggaaagcagatgcaagagatggagacagaatgggggtgtcctggggatcttggagcctgaattcattggcacaaaaggcagcagcatcctcactgtatctgcagtccatttggactcaataaaaactttgaaagtcacatgtgttatggaattccttctcagtgacacattcatctgtgctcagttgtcccagcaagggtcagcccctcatacccctgcagcatccgctgctatgaagcagagctgtaaacgccctccctgtgtataggaaaagctacatggagcaaatcctcctgcctgaagaagtgcatctcagcatcacttcagctgtcggggcatttgtggggagaaccagaccacctctgcggaaggcagcagaccctcttccagccatggatggagttgaattctctataaacggttcaccagcaaaccaccaatacattccattgtttgcctagagagaaatttaaaaataaataaatgttcacttataa

SEQ ID NO: 34518 - DNA, 3562 bp, Homo sapiens
aagatgccccggccggagctgcccctgccggagggctgggaggaggcgcgcgacttcgacggcaaggtctactacatagaccacacgaaccgcaccaccagctggatcgacccgcgggacaggtacaccaaaccgctcacctttgctgactgcattagtgatgagttgccgctaggatgggaagaggcatatgacccacaggttggagattacttcatagaccacaacaccaaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagcttggtctctggttcatcatccagctccaagtatgaccctgagatcctgaaagctgaaattgccactgcaaaatcccgggtcaacaagctgaagagagagatggttcacctccagcacgagctgcagttcaaagagcgtggctttcagaccctgaagaaaatcgataagaaaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacac

SEQ ID NO: 34519 - DNA, 1294 bp, Homo sapiens
cggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagctacttgtg

SEQ ID NO: 34520 - DNA, 1944 bp, Homo sapiens
gggccagcctccgcactcgagctttgattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgga

SEQ ID NO: 34521 - DNA, 1374 bp, Homo sapiens
gttggagagactatggcgctcaacaagaatcactcggagggcggcggagtgatcgtcaataacaccgagaggcttgaaaaacaaaccagcaaaaacagaacatctatcacaaggacttaaaagaaaatagaagagttggccgggcgcagtggctcacgcctgtaatccctgcactttgggaggccgaggcaggtggatcacgaagtcaggagatcgagaccatcctggctaacacgcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccggg

SEQ ID NO: 34522 - DNA, 987 bp, Homo sapiens
attgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcaggtgagggcccttgggtgctggcagcccttcgggaccagccctctcctccccgatgtcgcacagagagcctcagaatggccagagactgctgagagccgcagatgatggatgacccctggactaccccaggggcccagcagggctgtggcctggtggagcggagctagattctggccccacccccatcccttagctatccatgtgccctgggcggggaaggtcaccctgtgtgcctctcgatcctctcatctacactcagctggtcggtcacagtggcacctggggcattggctcaaggattagatgaggtgagacatgcgatgggcctggaaaggaccgtgccagcgcgtggcatgtgctcaggaaacctcacctgctgctctcatt

SEQ ID NO: 34523 - DNA, 658 bp, Homo sapiens
gagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggccccgatgtcccctccactcctgcagccgaagccaaggccgcagaagcagccgccagcgcctattacaacccaggcaatagccagccgccgccacctccctactacccaccggaagatagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattag

SEQ ID NO: 34524 - DNA, 928 bp, Homo sapiens
attgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtct

SEQ ID NO: 34525 - DNA, 3362 bp, Homo sapiens
attttgggacatggccactgcttcaccaaggtctgatactagtaataaccacagtggaaggttgcagttacaggtaactgtttctagtgccaaacttaaaagaaaaaagaactggttcggaacagcaatatatacagaagtagttgtagatggagaaattacgaaaacagcaaaatccagtagttcttctaatccaaaatgggatgaacagctaactgtaaatgttacgccacagactacattggaatttcaagtttggagccatcgcactttaaaagcagatgctttattaggaaaagcaacgatagatttgaaacaagctctgttgatacacaatagaaaattggaaagagtgaaagaacaattaaaactttccttggaaaacaagaatggcatagcacaaactggtgaattgacagttgtgcttgatggattggtgattgagcaagaaaatataacaaactgcagctcatctccaaccatagaaatacaggaaaatggtgatgccttacatgaaaatggagagccttcagcaaggacaactgccaggttggctgttgaaggcacgaatggaatagataatcatgtacctacaagcactctagtccaaaactcatgctgctcgtatgtagttaatggagacaacacaccttcatctccgtctcaggttgctgccagacccaaaaatacaccagctccaaaaccactcgcatctgagcctgccgatgacactgttaatggagaatcatcctcatttgcaccaactgataatgcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtgggaacaaagaaaagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttg

SEQ ID NO: 34526 - DNA, 2972 bp, Homo sapiens
attttgggacatggccactgcttcaccaaggtctgatactagtaataaccacagtggaaggttgcagttacaggtaactgtttctagtgccaaacttaaaagaaaaaagaactggttcggaacagcaatatatacagaagtagttgtagatggagaaattacgaaaacagcaaaatccagtagttcttctaatccaaaatgggatgaacagctaactgtaaatgttacgccacagactacattggaatttcaagtttggagccatcgcactttaaaagcagatgctttattaggaaaagcaacgatagatttgaaacaagctctgttgatacacaatagaaaatttaatggagaatcatcctcatttgcaccaactgataatgcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtgggaacaaagaaaagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttg

SEQ ID NO: 34527 - DNA, 2708 bp, Homo sapiens
attttgggacatggccactgcttcaccaaggtctgatactagtaataaccacagtggaaggttgcagttacaggtaactgttaatggagaatcatcctcatttgcaccaactgataatgcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtgggaacaaagaaaagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttg

SEQ ID NO: 34528 - DNA, 2163 bp, Homo sapiens
atggccactgcttcaccaaggtctgatactagtaataaccacagtggaaggttgcagttacaggtaactgtttctagtgccaaacttaaaagaaaaaagaactggttcggaacagcaatatatacagaagtagttgtagatggagaaattacgaaaacagcaaaatccagtagttcttctaatccaaaatgggatgaacagctaactgtaaatgttacgccacagactacattggaatttcaagtttggagccatcgcactttaaaagcagatgctttattaggaaaagcaacgatagatttgaaacaagctctgttgatacacaatagaaaattggaaagagtgaaagaacaattaaaactttccttggaaaacaagaatggcatagcacaaactggtgaattgacagttgtgcttgatggattggtgattgagcaagaaaatataacaaactgcagctcatctccaaccatagaaatacaggaaaatggtgatgccttacatgaaaatggagagccttcagcaaggacaactgccagttaatggagaatcatcctcatttgcaccaactgataatgcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtgggaacaaagaaaagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataaggtttgaagattttgttttgcaataagtcatttttttgaaacccattttgtttcattttgttaattagtgtatatatatttatttcacccagagataacaacattgaagaatgtggcttagaaatgtacttttctgttgacatggagattttgggaaaagttacttcacatgacctgaagttgggaggttccaatattctggtgactgaggagaaca

SEQ ID NO: 34529 - DNA, 4686 bp, Homo sapiens
ggcgagctccgcgtgcgggttccgagtggctgctggcggcctgggctgccggggccgacgcctgggtggctgctgccgccgcgcctgctgcgagatggcgatcttgggcgcggaagggtgagggcgcccgccgcaggaggaggtgccgctgccgtggccgcccggctgccgggagccgacagcttcgcgccggggttgtctcctcacagactatgagctccttgaaagagggaatcgtgtcttactcatctttgtatccccagtgtctagcagttcctgatacatagttttagctgaattttgggacatggccactgcttcaccaaggtctgatactagtaataaccacagtggaaggttgcagttacaggtaactgtttctagtgccaaacttaaaagaaaaaagaactggttcggaacagcaatatatacagaagtagttgtagatggagaaattacgaaaacagcaaaatccagtagttcttctaatccaaaatgggatgaacagctaactgtaaatgttacgccacagactacattggaatttcaagtttggagccatcgcactttaaaagcagatgctttattaggaaaagcaacgatagatttgaaacaagctctgttgatacacaatagaaaattggaaagagtgaaagaacaattaaaactttccttggaaaacaagaatggcatagcacaaactggtgaattgacagttgtgcttgatggattggtgattgagcaagaaaatataacaaactgcagctcatctccaaccatagaaatacaggaaaatggtgatgccttacatgaaaatggagagccttcagcaaggacaactgccaggttggctgttgaaggcacgaatggaatagataatcatgtacctacaagcactctagtccaaaactcatgctgctcgtatgtagttaatggagacaacacaccttcatctccgtctcaggttgctgccagacccaaaaatacaccagctccaaaaccactcgcatctgagcctgccgatgacactgttaatggagaatcatcctcatttgcaccaactgataatgcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtgggaacaaagaaaagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttgaaaatttttctctgttacatcagtaatattgttaaagtaatggatagaaccataacttacacatgaaagtcatatactagatccaatactatttagtttattatcgaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgattttctgttagtgtttgaatatcttcattcctctcaaattcataacagttctatttaactgaattaaataaccatatgaaaaatcttttgggtctccccctttttacacagataattatttttgtcataacactttttaattgtttttcatcataggggcctttgctgaactacaaaaatgtgtaacaaattaaaatctgatgtgaatgatattaatgctacttttagcaaactgggcttcctaatacaaaattttaaatttccatttgtatcatgcttttaatatgcactgtaaatttcattaacttaaacattttttaatagccatggaactgacttcttaaaatctgttgcctataaatatttcactgctaagtacatacagaaaaacagtaattattgttttgccaaaattttatttttctacatattgagagtgtgttctccattttattcagaattcatagtaaagacgaaagaaaggcagagatctgcttggttgaatagactccttttccaaatccttattatgaacactctggtaattttcaagcctaaagaattaaaaaaaaaattctaatgtatgtgacaggttatgtgatagagggaaactggccttcaaaaaggactgcgt

SEQ ID NO: 34530 - DNA, 4439 bp, Homo sapiens
ttgtcttacagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacagaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagccaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcagcctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgt

SEQ ID NO: 34531 - DNA, 4515 bp, Homo sapiens
gcgcggtcacgtgacccggcccgagtgcgggcggtggaaggcggaagtaggagaggagttcggcgccgcttctgtggccacggcagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacagaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagccaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcagcctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgtg

SEQ ID NO: 34532 - DNA, 4491 bp, Homo sapiens
ttcggcgccgcttctgtggccacggcaggtagcgagcgctggcgcggggggcgcgtcttacagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacagaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagccaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcagcctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgt

SEQ ID NO: 34533 - DNA, 2569 bp, Homo sapiens
attttatagaaacgtttagtactcaccaaggccctcagtggaactggctgaaaatagcagcagactcactcagaaaagaattggagagatccatggcagggaagagagattaagggaaggtagagcgcttaggagagcttgaaaacccaaaggtggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacagaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcag

SEQ ID NO: 34534 - DNA, 2723 bp, Homo sapiens
atggggaaagagagagggtgctccgagggggttgtgggaggtacagattccctgtggcacctccgactttttctacctatggtacccaaggaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacagaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaa

SEQ ID NO: 34535 - DNA, 4471 bp, Homo sapiens
ggcggaagtaggagaggagttcggcgccgcttctgtggccacggcagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacagaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacgcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagccaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcagcctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgt

SEQ ID NO: 34536 - DNA, 3672 bp, Homo sapiens
cccctcctgcgtgtggttcttggagaaagttggaggtggtggtgatttcagtcgccttggccgccttgagccggagctgagcggaggcactgggccgagcctgcttcccgggccttcctaccatgccagggctgctccctgcctccgccaccctggcacaccttcacccgcgtaccgcctcctccccgtcgctctgccttttccaaaactcacttgggccctccgtgcgcagggttcttttttggtttttctgtaaaaatcaaaacaaaaaacagagacttttgagaggagcagatgccacctaaagtcccactgcattccctgcaaagcgctcaaatgtggaagccagtcattggcatttttattttttattgattgattgattttttcaccagtggctttttgtaacctctgtgttctgctgtgtttcttgtgtttagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacagaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagccaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcagcctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagct

SEQ ID NO: 34537 - DNA, 2474 bp, Homo sapiens
agatgaaacagaaaggctaaagagggctggagtcaggggacttctcttccaccagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccagggtaggtcatcaactgagaagacctgagactctggaactgacaccatgagtcacccaatggcttcttgaaacggtccctttctgcggaggtagcatagcacagtgacgtttattccgggtcacttgattgcttttcctatccacttaccttaatattgctcccatgtcttaggacatattagaattattagaagatctctgggaaacaaaaggcgcatgggaggccaagatttagagtgttgatgcattccgccgtaccctatgcccagcctgtccctaaaggcagagtgcttcttattcggcagggcttcgtgagaatgccgccaagttatccaaaaccaaaggatgagagaggcttccaagagagggaagactgtccaagttcaaggagaaggggtttggttccctgtctgccagggacagaaagttctttccacatgtgtctcctggtcccgagagctttcaaaaggggatgtattctgctccaagaaagaatcacctcccagtaaagtagccatgaagggctcctgtataaaatatgcacacttcccctgccctgagtttgtggagggaaaggctgtcggaagtagggactcttaggagagcccgtgtgccctgtttggttcagctgtcaggcgtgtgccacacacatcccacctcatcttctggtcccataattctccatggatgggctgcttttagctccagttttccagtagaatgcttgagttttccttttttccgtacctcctggaggatgaaactcataacctgtcatcatcagtactcactgtgttttccactttgacttgaagtcaaatgaagttaccaaagttaaacatggacttctcaaattagaaaaaaacaaacaacaaaaaaacaggttaagtgttttgttatgaaaattatgaaaatgttcttattattatggaaaatttcaaatagatatagagagaataatgttacaaacccccacatactcaacatttagcttcaaaaattatcaactcatggcgggttttgtttcatctgtacaaactagtcggcacactatgatggcctgtggacaaaatccggccctctgactgtttttgtaaataaggttttattggaacacagccacacatatttgttgacttattgtttttggctgtttttgtacttcattggcagagttgagtaattgcagcagactctatggcttgcaaaacctaaaataattactttgtgtagcgctttatagaaaaaatttgctaactcccgatctgtaacccccaacctatccgccgcaccctgatctaggtaattttgaagcaaatcccaaatgtcacatcatctatccatatttcactatgtatttctaaaacatattcttttattcaaaataaaactctaatatca

SEQ ID NO: 34538 - DNA, 474 bp, Homo sapiens
gggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaatgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 34539 - DNA, 614 bp, Homo sapiens
ggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 34540 - DNA, 622 bp, Homo sapiens
gttaatggggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 34541 - DNA, 350 bp, Homo sapiens
atggagagccccaaaaagaagaaccagcagctgaaagtcgggatcctacacctgggcagcagacagaagaagatcaggatacagctgagatcccaggtgctgggaagggaaatgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 34542 - DNA, 474 bp, Homo sapiens; identical to SEQ ID NO: 34538

SEQ ID NO: 34543 - DNA, 614 bp, Homo sapiens; identical to SEQ ID NO: 34539

SEQ ID NO: 34544 - DNA, 350 bp, Homo sapiens; identical to SEQ ID NO: 34541

SEQ ID NO: 34545 - DNA, 622 bp, Homo sapiens; identical to SEQ ID NO: 34540

SEQ ID NO: 34546 - DNA, 472 bp, Homo sapiens
cctagactaaccagtttgtgttggtcctccgctgagctgttaatccagggaagagttgcccttctgaagaatatgtggatttaatggagaccaagacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcacc

SEQ ID NO: 34547 - DNA, 474 bp, Homo sapiens; identical to SEQ ID NO: 34538

SEQ ID NO: 34548 - DNA, 614 bp, Homo sapiens; identical to SEQ ID NO: 34539

SEQ ID NO: 34549 - DNA, 622 bp, Homo sapiens; identical to SEQ ID NO: 34540

SEQ ID NO: 34550 - DNA, 350 bp, Homo sapiens; identical to SEQ ID NO: 34541

SEQ ID NO: 34551 - DNA, 474 bp, Homo sapiens; identical to SEQ ID NO: 34538

SEQ ID NO: 34552 - DNA, 614 bp, Homo sapiens; identical to SEQ ID NO: 34539

SEQ ID NO: 34553 - DNA, 622 bp, Homo sapiens; identical to SEQ ID NO: 34540

SEQ ID NO: 34554 - DNA, 497 bp, Homo sapiens
gtgagggtgtgagggtcgcgttcctgctgtctggactttttctgtcccactgagacgcagctgtgtgaaatatgatttggcgaggaagatcaacatataggcctaggccgaggagaagtgtaccacctcctgagctgattgggcctatgctggagcccggtgatgaggagcctcagcaagaggaaccaccaactgaaagtcgggatcctgcacctggtcaggagagagaagaagatcagggtgcagctgagactcaagtgcctgacctggaagctgatctccaggagctgtctcagtcaaagactgggggtgaatgtggaaatggtcctgatgaccaggggaagattctgccaaaatcagaacaatttaaaatgccagaaggaggtgacaggcaaccacaggtttaaatgaagacaagctgaaacaacacaaaactgtttttatctaagatatttgacttaaaaatatcgaaataaacttttgcagctttctccaaa

SEQ ID NO: 34555 - DNA, 486 bp, Homo sapiens
aagcattcagaaggcacacatacttacacttgccctgagacttagttcgaaatgtgaaatatgatttggcgaggaagatcaacatataggcctaggccgaggagaagtgtaccacctcctgagctgattgggcctatgctggagcccggtgatgaggagcctcagcaagaggaaccaccaactgaaagtcgggatcctgcacctggtcaggagagagaagaagatcagggtgcagctgagactcaagtgcctgacctggaagctgatctccaggagctgtctcagtcaaagactgggggtgaatgtggaaatggtcctgatgaccaggggaagattctgccaaaatcagaacaatttaaaatgccagaaggaggtgacaggcaaccacaggtttaaatgaagacaagctgaaacaacacaaaactgtttttatctaagatatttgacttaaaaatatcgaaataaacttttgcagctttctccaaa

SEQ ID NO: 34556 - DNA, 5688 bp, Homo sapiens
gtctcttaggagtgaggtacctggagttcggggaccccaacctgtgacaatgacagcagacaaattggttttctttgtgaatggcagaaaggtggtggagaaaaatgcagatccagagacaacccttttggcctacctgagaagaaagttggggctgagtggaaccaagctcggctgtggagaggggggctgcggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccctggcatcgtcatgagtatgtacacactgctccggaatcagcccgagcccaccatggaggagattgagaatgccttccaaggaaatctgtgccgctgcacaggctacagacccatcctccagggcttccggacctttgccagggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagctttacagttccttttctgaatcaggcaggagccctacttcatgtgtacacagatggctctgtgctgctgacccacggggggactgagatgggccaaggccttcataccaaaatggtccaggtggccagtagagctctgaaaatccccacctctaagatttatatcagcgagacaagcactaacactgtgcccaacacctctcccacggctgcctctgtcagcgctgacctcaatggacaggccgtctatgcggcttgtcagaccatcttgaaaaggctggaaccctacaagaagaagaatcccagtggctcctgggaagactgggtcacagctgcctacatggacacagtgagcttgtctgccactgggttttatagaacacccaatctgggctacagctttgagactaactcagggaaccccttccactacttcagctatggggtggcttgctctgaagtagaaatcgactgcctaacaggagatcataagaacctccgcacagatattgtcatggatgttggctccagtctaaaccctgccattgatattggacaggtggaaggggcatttgtccagggccttggcctcttcaccctagaggagctacactattcccccgaggggagcctgcacacccgtggccctagcacctacaagatcccggcatttggcagcatccccattgagttcagggtgtccctgctccgcgactgccccaacaagaaggccatctatgcatcgaaggctgttggagagccgcccctcttcctggctgcttctatcttctttgccatcaaagatgccatccgtgcagctcgagctcagcacacaggtaataacgtgaaggaactcttccggctagacagccctgccaccccggagaagatccgcaatgcctgcgtggacaagttcaccaccctgtgtgtcactggtgtcccagaaaactgcaaaccctggtctgtgagggtctaaagagagagtcctcagcagagtcttcttgtgctgcctttgggcttccatggagcaggaggaacataccacagaacatggatctattaaagtcacagaatgacagacctgtgatttgtcaagatgggatttggaagacaagtgaatgcaatggaagattttgatcaaaaatgtaatttgtaaacacaatgataagcaaattcaaaactgttatgcctaaatggtgaatatgcaattaggatcattttctgtctgttttaatcatgtatctggaatagggtcgggaagggtttgtgctattccccacttactggacagcctgtataacctcaagttctgatggtgtctgtcctttgaagaggattcccacaaacctctagaagcttaaaccgaagttactttaaatcgtgtgccttcctgtgaaagcctggccttcaaaccaatgaacagcaaagcataaccttgaatctatactcaaattttgcaatgaggcagtggggtaaggttaaatcctctaaccatctttgaatcattggaaagaataaagaatgaaacaaattcaaggttaattggatctgattttgtgaagctgcataaagcaagattactctataatacaaaaatccaaccaactcaattattgagcacgtacaatgttctagatttctttcccttcctctttgaagagaatatttgtattccaaatactctttgagtatttacaaaaaagattatgtttaatctttacatttgaagccaaagtaatttccacctagaaatgatgctatcagtcctggcatggtggctcacccctataatcccagcactttgggaggctaaggcaggagaattgcttgagcccagcagtttgagaccagcctgggcaacatagagagctcctgtctttaaaaaaaatttttttaattagttggtcttgatagtgcatgcctgtagtcccaactacttgaaaggctgaggtggagagatcatttgagctcaggaggttgaggctgcagtgagctatgattgcgccactgcactcctgcctgagcgactgagcaagatcttgtctctgaagaaaaaaaaagaaataaaaatgctgctatcaaaatcaagcccaaccagaggtagaagagccaagaagcctgggttctcatcctagctctgtctcttctgtctctatctttgtgatcttggactgtcaattccccttcctgtgatccattttactgcaaacataagggttgcagtaaagggttgtctcacgtcttctgctttaaaagcctataaatatatgacctgaaaactccagttacataaaggatctgcagctatctaaggcttggttttcttactgtcatatgatacctgggtctaatgaactctgctgagatcacctcaagtttctgcggttggtaaagagaacaagggaagaacaaacatcccttttattgctccaaatggtgatttaatccctacatggtgctgggtggacaatgtgtcactgtcacatgccttcactgtataaatccaaccttctgccagagagaatctgtggttctggccatggagggaggatagtggaaatgatatagttggactggtgcttgatgtcactaataaatgaaactgtcagctgg

SEQ ID NO: 34557 - DNA, 4126 bp, Homo sapiens
ggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcataacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataa

SEQ ID NO: 34558 - DNA, 8474 bp, Homo sapiens
gcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcataacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaatgtgtatccagagacatttgaattattaactttattctttattagtgaatctctatgatggcacacataaaatcttacagttgacttctgctgtttgaattccccagtgtttttacattaatgtatcctatggccagtttagtctttcttcaactgttacagttctaggccctaatcggtcttattctttcacatatgatgcaatgatagatgtaatccttttctgaagtgtttgtcggattggcatagtctattcaaaaataaggcttatgtaactttcagcttgctatgtgacagaagtttaaatgtgtatttaagtacacagctttatgttcctcttaaagctgtaaagagaaaagaggacttttcctcatcaagagagcttgggagacaaagcatacatttaatttttttctttcaaaaaaggcaatgtgcactttcctctcctaaattttatatgccctagcagttgcgaatgttgtgtccaccttacaatttgattggaggctcccatacactgaaactctcaatagaattcttaaaaatgaacatcagctgggcgcagtggctcacgtctgtaatcccagcactttgggaggccaaggtgggcagatcacgagctcaggagttcgagaccagcctgaccaacatggtgaaaccccgtctctactaaaaatacaaaaattagctgggcgtggtggcgcatgcctgtaatcccagctactcaggagactgaggcaggagaattgcttaaacctgggaagcagaggttgcagtgagactagatcatgccactgcactccactgccactgcctgggcaacagagcaagactccatctcaaaaacaaacaaaaaaaatcacagactcattttaaaggagcagcaacctaaccaaatacaaacttcatttgattttaggtttagaaattctagttttattttggagaatcactcagtttttaatatcaattaaaatagtcctcaaaggaatgaagaggaagtctaaataaatgaataaaactcatttttcattttatggtagtatagaaagcattgatgtgtgtagagaaattaaaagacaagagtggtttactgtctatgcacaaatgagtgcctatatttaaggctgcctataccattacagtggcgtaattggtgatttcatagcatacagagaaacaatgaaatcaaagattaaatcattaggttatgatggtcatttgtaagattggaaagtagtcaaaaacccatgtgcaactttttttcagcactctaccattaggctccttaggcaagctgcttaacttccgtcagaagcaaaggtgtgggagaacaccattcacctcagtagtaacttataaaaaccgtttaaagaaggaaaatgggccccagcccctaggatccctgacttcctgatattctaaacatgagagttctgtgactttaactgagctctttaccagaagtaacgtgttgatgtatattatctttccaccatgctttgaccaaagtacattcacagtaactagagaaagcagatcatccatttctggataggtgaactacggcaaggtaagaacagaaaaaagtaaagtagtattgagtcatgcaggtatcagattaacagacattcattgaagataagtgaaataactttggagatagcagagaagagcaagaagatgttggacgttggcagtaagccgcagcaaggcagttaggaaagtacgtgagcctgatgacgcgaaggtgatgcctccatctgtccgcttagtggttattaaattgctgggaaagacctgcctttattttcctatcatcttttccccattactttgcattattcaggaaataattatttattcccaaatgcagttttctaagcagtgaccacaaaaatttcttattctaaggaaaataattaagaaaataaccctatctgtggcattgttttaaaatgtgggatacaaatctggtaagcagatttcaggtcattattgttttcttttaatggtttacatgaaattttcctctcaaaaaacaagtacctcttactgtataacatttgagtttttaaaattgagatagcttctgagagaaaaaaagaaagttgaatttgtagctctctcaactacaaaatcaccacacttttctcaaatctaataggaattcagtgtcattacagatacggtctctagtgaccaggtgaagacaattgaagctttggtagaacttctgcaaaagttaggtaaagaagaataaatccaatttatcagctttgttcatattctttttctgagtgatctaaatttttcttgcttgtgatcattagctaagacaaggagtgttaaaggttttctaaatgcaaacacatacgtttctgcatttcagaagtcagtcttgatagtaaatcctacaaactctcaactttctgcattgtattttaagtctatacaatgttagagcacatggtaatgtgggacagagttgattatatgatagcatgagaaatttgcactggttggtgttacaaaccaatgatctaaccagcatactctccaaatatgaaaaagtaaaaacatctcattaggtttggaagagcctaaggtagtccatacaggaagtttgcctgagaacagagaggagcctgttgattggcatggctcatgatgcctttcttgtatgaattatcaaaactgatactgagttgcccctagaaaacagccttccagaatatgtttgcttatttatggtggaagaggaagtgagaacaagatgagagtttcccttaaagtgaggagaatcattatacaactttgcaactgaagtatgtttccttgtagcaaacctttggtttattttatcgtcaaatcaaagccaccctcagttttttgtatggtgccatcaacctaaggaggacaatcaaataacctattgtttgccttggattcagtatatctactaagtacacagtctcgtataccttcaaaccagttacttgactaaacttccaccatattaccttagttcttcctatgccctttcctctgtgccaccacaaatcagagggaaagactgcagtacttctagaaagttgtggacttctaagaaagagccaggcttccatctcactatcccttgatcattatctctgaagtccctacctgcacttccctgattgccctgtagcaacaccagcatggtgggaattggagggaaagattgtggaaaatccctaaagggtcattgttcatgacgttattttgaattgtaaaattgtgagccactcacatttcaattacaaaaagaacagaactcttaatcacgttgtgaagattaatttcttgccattttctggattagcacagaagcttgtatcaatgaagagtatttaggaggggaatagggggaaaattgtatttttctgttcaaactctctccttctatttgtgtttccttcacccctctccctccaccacactgtgttggtcaaatgatactattctatgaaaccctgagctatagttgtcaaaagtaactatggattgtgattagtcctctgtgggtgcttccttccctcttttttctccctcactctctttctcagtctccactctggtaaatggaaaaggtgatgtcgaagaattgatgcttgcttggactcatgttgtatctgtgactatgctattagctgtctcctttttccttcctatatgggtagaattcttatgacttatgaagttcccttcttgataagtaggttaaatgcacaatgtggtactgttttatagtttctagatggttgtataaagcaaaaagttaatgtggttatgtgtttttaaagaaaataagtgattggtcactaaactctgtccttttttcattattacaatttctctctgttttccaaca

SEQ ID NO: 34559 - DNA, 2315 bp, Homo sapiens
gtgtgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcagatatctacccaaagccaaaaccaccttactacccacagcccgagaatcccgacagcggtggaaatatctacccaaggccaaagccacgccctcaaccccagcctggcaattccggcaacagtggaggttacttcaatgatgtggaccgtgatgacggacgctacccgcccaggcccaggccacggccgcctgcaggaggtggcggcggtggctactccagttatggcaactccgacaacacgcacggtggagatcaccattcaacgtatggcaatccagaaggcaatatggtagcaaaaatcgtgtctcccatcgtatccgtggtggtggtgacactgctgggagcagcagccagttatttcaaactaaacaataggagaaattgtttcaggacccatgaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataa

SEQ ID NO: 34560 - DNA, 979 bp, Homo sapiens
gtgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcagatatctacccaaagccaaaaccaccttactacccacagcccgagaatcccgacagcggtggaaatatctacccaaggccaaagccacgccctcaaccccagcctggcaattccggcaacagtggaggttacttcaatgatgtggaccgtgatgacggacgctacccgcccaggcccaggccacggccgcctgcaggaggtggcggcggtggctactccagttatggcaactccgacaacacgcacggaagagggggctatagactcaactctcgttatggaaatacttatggtggagatcaccattcaacgtatggcaatccagaaggcaatatggtagcaaaaatcgtgtctcccatcgtatccgtggtggtggtgacactgctgggagcagcagccagttatttcaaactaaacaataggagaaattgtttcaggacccatgaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattg

SEQ ID NO: 34561 - DNA, 2887 bp, Homo sapiens
gtgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcagatatctacccaaagccaaaaccaccttactacccacagcccgagaatcccgacagcggtggaaatatctacccaaggccaaagccacgccctcaaccccagcctggcaattccggcaacagtggaggtagttacttcaatgatgtggaccgtgatgacggacgctacccgcccaggcccaggccacggccgcctgcaggaggtggcggcggtggctactccagttatggcaactccgacaacacgcacggtggagatcaccattcaacgtatggcaatccagaaggcaatatggtagcaaaaatcgtgtctcccatcgtatccgtggtggtggtgacactgctgggagcagcagccagttatttcaaactaaacaataggagaaattgtttcaggacccatgaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataactggatttgattattgaatagtttttttctatatttcacaaataaattgtatgaaatgactgtagaagtggccccaaaattatgaaccttcgtagctgtgaatatgatgccataaatctcttttaaagctcaagatagactatgaacatatgaaatacatagttacctaatcatgagactaaattcacctgggtgacaaggctaacgttcaagctacttaagatgaaaatatttgaatcatgattgcttgggggaacctctctttgaggggtcatgaggaccacctgctgggcattctgttttcatgctgagaaggtgagaattgaacagatgagaaaagccttgataaaacgtcatctccatgtaatttagagaaggataaccttgactgtacagctgacccttgaacaacacagggctgaactgcacatgtccacctgtatgtgagtttgcttctggctctgccattactgagacagcaggaccaaccctccatctactcaatgggaagatgataaggatgaagacctttatggtgatccgcttccacttaataaatagtaaattcatt

SEQ ID NO: 34562 - DNA, 894 bp, Homo sapiens
tcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggctggctgtcccagatccaagattagatttttcagttccgtacgaggacctctttaagaaactccaatgaactcataaagtacaggatttgaacaacggttgagtcaaagagactttgatttggcagatgcccttgatgaccctgaacccaccaagaagccaaactcagatatctacccaaagccaaaaccaccttactacccacagcccgagaatcccgacagcggtggaaatatctacccaaggccaaagccacgccctcaaccccagcctggcaattccggcaacagtggaggtagttacttcaatgatgtggaccgtgatgacggacgctacccgcccaggcccaggccacggccgcctgcaggaggtggcggcggtggctactccagttatggcaactccgacaacacgcacggtggagatcaccattcaacgtatggcaatccagaaggcaatatggtagcaaaaatcgtgtctcccatcgtatccgtggtggtggtgacactgctgggagcagcagccagttatttcaaactaaacaataggagaaattgtttcaggacccatgaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattccca

SEQ ID NO: 34563 - DNA, 12582 bp, Homo sapiens
atgttcccaatgcagaagggctccctcaacctcctgaggcagaaatgggaatcttgtgattatcagagaagtgagtgtcatcccagggacagccattgtacaattttccagcctcaggaaagcaaattgcttgcgcctgaaggagaggtagtatcagcacctcaatctttggatcccacaagtctgccctacagtacaggggaagagatgtggagttcgaagccggaagagaaggattctgtggacaagagtaacaacaccagggaatatggtcggccagaagtgctgaaggaggattccctgagcagtcggcgcaggattgaacgcttttccattgcccttgatgagctgaggagtgtgtttgaggctcctaagagtggaaacaaaccagctgagtacggtggaaaggaagtggaaattgagcgaagtttgtgctcgccagcttttaagagtcaccctgggagccagctggaggattctgtgaaagattcagacaagaaaggcaaggaaacatcttttgacaagatgtcacctgaaagtggtcacagccgcatctttgaagcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagactgaaagtgaatatgaagagactttcaagccatcatcagttgtgagtacctcttccacttcttgcgtttcaaccagccagaggaaggaaacatcaactacaagatatagtgatcacagtgtcacttcctcaactctggcacaaattaatgctacttcttcaggaatgacagaagaatttcctcctcccccacctgacgtacttcaaacttcagtagatgtgacagcattttcccagtcccctgaactgcccagtcctcctagaagactaccagtccccaaagatgtatattccaagcaaagaaatttgtatgaattaaaccgtttatataaacacatccatcctgagttaagaaaaaacttagaaaaagattatatcagtgaagtttctgagattgtttctagtcaaatgaactcagggagttcagtctcagcagatgtgcaacaagcccggtatgtttttgaaaacacaaatgacagttctcaaaaagatctgaactcagaaagagaatacttggaatgggatgaaattctgaagggagaggtgcagtccattagatggatctttgagaatcaaccattggattccatcaacaatggctctcctgatgaaggtgatatttccaggggcattgctgatcaagaaatcattgctggtggtgatgtgaaatataccacatggatgtttgaaacccaacccatcgacacacttggggcttattcttctgacactgtagaaaatgcagagaaaattcctgagctagccagaggagatgtctgcacagctcggtggatgtttgaaacaaggccattggactcaatgaataaaatgcatcaaagtcaagaagaatcagcggtaactatcagtaaggacataactgggggggatgtcaagactgtgagatacatgtttgaaactcaacatctagatcaacttggacagcttcattcagtggatgaggttcatttactgcagcttaggtctgagctcaaagaaattaagggaaatgttaaaagaagtataaaatgtttcgaaactcaaccattatatgttattagagatggttcgggccaaatgctggaaattaaaactgttcacagagaagacgttgaaaagggagatgtaagaacagcacggtggatgtttgaaacacagccgttggacacaattaacaaagatatcacagaaattaaagttgtccgaggaatatccatggaagaaaatgtcaaaggtggggtgagtaaggcaaagtggttatttgaaacccaacctttggagaaaatcaaagagtcagaagaggtcatcattgaaaaggaaaaaataataggtacagatgtctccagaaagtgttggatgtttgaaacccagccattagacattctaaaagaagttcctgatgcagattctctacaacgtgaggagataataggtggtgatgtacaaactactaagcatctatttgaaacacttccaattgaagcattaaaagacagtcctgatataggaaagcttcaaaaaatcactgcctctgaagaagaaaaaggggatgttaggcatcaaaaatggatttttgaaacccaacctctggaagacattagaaaagataaaaaggagtacacacgaacagtgaaacttgaagaagttgacagaggagatgtgaagaattacacacatatctttgaatcaaacaatttaattaaatttgatgcatcacataaaatagaggtggaaggagttacaagaggtgctgtagagttaaataaatctctcttcgagacaacaccactgtatgccattcaagatccccttggaaaatatcatcaagtaaagacagtccagcaagaagaaatcgtaagaggtgatgtaagaagctgtaggtggctttttgaaacaaggcccattgaccagtttgatgaaagcattcataaatttcaaataattagaggaatatctgctcaagaaatacagactggaaatgtgaaatctgccaaatggttgtttgaaacccaacctcttgattcaattaaatattttagtgatgtggaagaaacagaaagtaaaactgaacaaactagagatattgttaaaggggatgtcaaaacctgtaaatggctttttgagacccagccaatggagtctctttatgaaaaagtttcgttaatgaccagcagtgaagaaattcataagggagatgtcaaaacttgtacttggctctttgaaactcagccacttgataccataaaagatgactctgaaacagcagtcaaattgcaaactgtaaaacaggaggagatccaaggtggggatgttcgtacagcatgttttctttttgagacagaaaatttggacagcatacaaggagaagaagtgaaggaaatcaagcctgttgaaatggatatacaagctggagatgtttccagcatgaggtataaatttgaaaatcagtccttagattctataagttctagttcagaggaagttttgaaaaagatcaaaaccttaaaaactgaagatattcagaaaggcaatgttttaaattgtaggtggctttttgaaaaccaaccaattgataagataaaagaaagccaagaaggtgatgaatgtgttaagacggtgacagacatacaaggtggggatgtaagaaaggggtgctttatttttgagactttttctttagatgagattaaagaagaatctgactatatcagcaccaagaaaacaattactgaagaagtaatacagggtgatgtaaaaagctacagaatgctctttgaaacccagccactctatgcaattcaagaccgagaagggtcctatcatgaagtgaccacagttaaaaaagaagaggtaattcatggagatgtgcgaggaacaaggtggctttttgaaacaaagccattagactctattaataaatcagaaactgtgtatgttattaaatctgtcacacaagaagacattcagaagggagatgttagttctgtcagatacagatttgaaactcagccactggatcagatttctgaagaatcacataatattatgcccagtattgaccatatacaaggtggcaatgtaaagacaagtagacaattctttgagtctgaaaattttgataagaataactatatacgaacagtaagtgtcaatgaaatacaaaagggcaatgttaaaacatctacttggctatttgaaacccacactatggatgaactgagaggagaagggttagaatatgaaaatatcaagacagtcactcaggaagatgtgcagaaaggtgatgttaagcaggctgtgtggctttttgaaaatcgaactttcgattctattatggaagcacataaaggtatcacaaaaatgaccaaggaagaaatccctccttctgatgtcaaaacaaccacatggctctttgaaacaacaccacttcatgaatttaatgaaactagagtagaaaagatagaaattattggcaagagcattaaagaaaccttagaagatctctactctcaaaaagttatccaggctcctggaatcatcattgaagctgatgaaataggggatgttcgaatggcaaaatacaagctaatgaaccaagcatctcctgagatacagaaagaagaaattatcagggctgatctcagaaatataatggtgaacctactttccaaaagggactgtactgaaagagagattttgattagtgaagaagagaagggaaatgttaatttgactaaaactcaattattaaacagatcaactgaatttcatgctgaaaaagaagagatagtgaaaggtgatgtacaacaagcaataaaaaacctgttctctgaggaaagatctgtaaagaaaggcatcttaattcaggaagatgaaaaaggagatattaacatgactatctattgtcttcttcatgaaaatgatggtgacacaattgagcgtgaagaagtaataggtggtgatgtcaaacgtaccattcataatttattgtcttccacatcaaacaataaaatatctgaaagggctaaaattgatgcctctgagagaggaaatgttcagtttttcacaacctgcatagaagctggagctttggattatctgaaacaactccacacagagtcaaatgaaacactgacagctaagaaacaagaaggagagaaagaaatcattggtggtgatgttgaaggtacaaaactgttactgaagaaaaggcagtctctggttgaacgtactgttagtgaaactgacatcatccctggagatgtgcataacacagttaaggtttttatgaccgagcctcagagtacatttggtaagatacccaaagaagagattataaaaggtgatttgacatcaaccctaaattccctcagccaggctgtaaatcagaaaacagtgacgaaaacagaagaaattataaaaggtaacatgctagccacactcaagtcacttaaagaatcaagccatcgatggaaagaatctaaacagcctgatgccatccctggtgatattgaaaaagctattgaatgccttgaaaaagctacaaatacaaagacagaaattctgaaaaaggagcttctcaaagatgacctggaaacatcactaaggtctttgaaagaagcacaaagaagtttcaaagaggtacataaagaaggtgtaataaaaaaagatgctaaagctgtgatggcaggatcctcgggagagcagaaaacagatattcatcaggttgctgtccagaggaacaaaaatagtcttcttcagccaaagccaggtccatttgagccagcggccaagtggcaagggggagcagatactctcagtcaaactatggggaaatcttgccatggcaatttagtagaagaaagaactgaggttaatcttccaaaagcccccaaaggcactgtaaagattgtcatagatcgtgaacaaaacaatgatgctctggagaaaagccttagaagactatctaattcacaccataaatctaatgttttggaatcaggagacaaaacgggtgtctggactgatactacaggagaacagcatcttagagatgaatatatgagcagacaattaacttcaactgtgtcagttaagaataatctaacaactaaagaatcagacagggcagtgagagagctgaagaaggatgatgtctttaattccatccaatctgctggtaaaaccgttggaaagcaacagacatatgaactgagaaatgaccaccagaaaatggagggttttcatataaagagtcctaaaaagaccaaaaatattaaaatattaactgatacacaaagctccaagcccagtcccacccagcatccagtcagcatgccagttggaggaacttacgacctttcaggggactttcagaagcaaactttgttaaagcaagaaacaaaatattctaataaggatataaagaaaaagaatataaaccttcaaccaatgtggcagcttttgcctgtagagcaagacacatccaatgtaacagaaatgaaagtctctgaaaaaagtcacaatacatttaaggcaaccaacaaaaagcgggagactgatgttcacttgaaaagccaggactttctaatgaaaacaaatacttccacaggcttaaaaatggcaatggaaaggtccttgaatccaatcaactttaaccctgagaataatgtaaaagaaagtgagtgcccccttccacctccatctccacctcctccaccaccttctaatgcatcatctgaaattgaatttcctcttcctcctccacctcctttgatgatgtttcctgaaaaaaatgggtttcttccctcactgtccacagagaagataaaggctgaatttgaaagttttccaggcctccctcttcctccacctccagtagatgagaaatctgaaagagaaagttcatcgatgtttctgccgcctcctcctcctccaactccatctcaaaagccagcacatctcctttcctcctctgctccggaaaagcacagtggagacttcatgcaacaatattcccaaaaagaagcctcgaactctcagaattctcaggctaaaatcataacaggaaaaaccggtgtgttgccacctcccacattgcccaaacccaaacttcccaagcatataaaagataataagaacgatttttcccccaaagttgaactggcaacctccctgtcagatatggaatgtaaaattactacctcaaaggatcagaaaaaagtaatggtgatgaccagcagtgaacacacggagacaaagcagaacgttattagtaagagtcttgatgaaagaaaacaattatctattgactctgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaaaaagaagaaattgaaaaacagaaacaggagagttcttactacaacattgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacattttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 34564 - DNA, 3292 bp, Homo sapiens
ggagaaatctggcaggtctctaggcagacaaaagggaacatctggtagggactgggacatgtagaaaaaaggacaacctggacccatccatgttcccaatgcagaagggctccctcaacctcctgaggcagaaatgggaatcttgtgattatcagagaagtgagtgtcatcccagggacagccattgtacaattttccagcctcaggaaagcaaattgcttgcgcctgaaggagaggtagtatcagcacctcaatctttggatcccacaagtctgccctacagtacaggggaagagatgtggagttcgaagccggaagagaaggattctgtggacaagagtaacaacaccagggaatatggtcggccagaagtgctgaaggaggattccctgagcagtcggcgcaggattgaacgcttttccattgcccttgatgagctgaggagtgtgtttgaggctcctaagagtggaaacaaaccagctgagtacggtggaaaggaagtggaaattgagcgaagtttgtgctcgccagcttttaagagtcaccctgggagccagctggaggattctgtgaaagattcagacaagaaaggcaaggaaacatcttttgacaagatgtcacctgaaagtggtcacagccgcatctttgaagcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 34565 - DNA, 12675 bp, Homo sapiens
ggagaaatctggcaggtctctaggcagacaaaagggaacatctggtagggactgggacatgtagaaaaaaggacaacctggacccatccatgttcccaatgcagaagggctccctcaacctcctgaggcagaaatgggaatcttgtgattatcagagaagtgagtgtcatcccagggacagccattgtacaattttccagcctcaggaaagcaaattgcttgcgcctgaaggagaggtagtatcagcacctcaatctttggatcccacaagtctgccctacagtacaggggaagagatgtggagttcgaagccggaagagaaggattctgtggacaagagtaacaacaccagggaatatggtcggccagaagtgctgaaggaggattccctgagcagtcggcgcaggattgaacgcttttccattgcccttgatgagctgaggagtgtgtttgaggctcctaagagtggaaacaaaccagctgagtacggtggaaaggaagtggaaattgagcgaagtttgtgctcgccagcttttaagagtcaccctgggagccagctggaggattctgtgaaagattcagacaagaaaggcaaggaaacatcttttgacaagatgtcacctgaaagtggtcacagccgcatctttgaagcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagactgaaagtgaatatgaagagactttcaagccatcatcagttgtgagtacctcttccacttcttgcgtttcaaccagccagaggaaggaaacatcaactacaagatatagtgatcacagtgtcacttcctcaactctggcacaaattaatgctacttcttcaggaatgacagaagaatttcctcctcccccacctgacgtacttcaaacttcagtagatgtgacagcattttcccagtcccctgaactgcccagtcctcctagaagactaccagtccccaaagatgtatattccaagcaaagaaatttgtatgaattaaaccgtttatataaacacatccatcctgagttaagaaaaaacttagaaaaagattatatcagtgaagtttctgagattgtttctagtcaaatgaactcagggagttcagtctcagcagatgtgcaacaagcccggtatgtttttgaaaacacaaatgacagttctcaaaaagatctgaactcagaaagagaatacttggaatgggatgaaattctgaagggagaggtgcagtccattagatggatctttgagaatcaaccattggattccatcaacaatggctctcctgatgaaggtgatatttccaggggcattgctgatcaagaaatcattgctggtggtgatgtgaaatataccacatggatgtttgaaacccaacccatcgacacacttggggcttattcttctgacactgtagaaaatgcagagaaaattcctgagctagccagaggagatgtctgcacagctcggtggatgtttgaaacaaggccattggactcaatgaataaaatgcatcaaagtcaagaagaatcagcggtaactatcagtaaggacataactgggggggatgtcaagactgtgagatacatgtttgaaactcaacatctagatcaacttggacagcttcattcagtggatgaggttcatttactgcagcttaggtctgagctcaaagaaattaagggaaatgttaaaagaagtataaaatgtttcgaaactcaaccattatatgttattagagatggttcgggccaaatgctggaaattaaaactgttcacagagaagacgttgaaaagggagatgtaagaacagcacggtggatgtttgaaacacagccgttggacacaattaacaaagatatcacagaaattaaagttgtccgaggaatatccatggaagaaaatgtcaaaggtggggtgagtaaggcaaagtggttatttgaaacccaacctttggagaaaatcaaagagtcagaagaggtcatcattgaaaaggaaaaaataataggtacagatgtctccagaaagtgttggatgtttgaaacccagccattagacattctaaaagaagttcctgatgcagattctctacaacgtgaggagataataggtggtgatgtacaaactactaagcatctatttgaaacacttccaattgaagcattaaaagacagtcctgatataggaaagcttcaaaaaatcactgcctctgaagaagaaaaaggggatgttaggcatcaaaaatggatttttgaaacccaacctctggaagacattagaaaagataaaaaggagtacacacgaacagtgaaacttgaagaagttgacagaggagatgtgaagaattacacacatatctttgaatcaaacaatttaattaaatttgatgcatcacataaaatagaggtggaaggagttacaagaggtgctgtagagttaaataaatctctcttcgagacaacaccactgtatgccattcaagatccccttggaaaatatcatcaagtaaagacagtccagcaagaagaaatcgtaagaggtgatgtaagaagctgtaggtggctttttgaaacaaggcccattgaccagtttgatgaaagcattcataaatttcaaataattagaggaatatctgctcaagaaatacagactggaaatgtgaaatctgccaaatggttgtttgaaacccaacctcttgattcaattaaatattttagtgatgtggaagaaacagaaagtaaaactgaacaaactagagatattgttaaaggggatgtcaaaacctgtaaatggctttttgagacccagccaatggagtctctttatgaaaaagtttcgttaatgaccagcagtgaagaaattcataagggagatgtcaaaacttgtacttggctctttgaaactcagccacttgataccataaaagatgactctgaaacagcagtcaaattgcaaactgtaaaacaggaggagatccaaggtggggatgttcgtacagcatgttttctttttgagacagaaaatttggacagcatacaaggagaagaagtgaaggaaatcaagcctgttgaaatggatatacaagctggagatgtttccagcatgaggtataaatttgaaaatcagtccttagattctataagttctagttcagaggaagttttgaaaaagatcaaaaccttaaaaactgaagatattcagaaaggcaatgttttaaattgtaggtggctttttgaaaaccaaccaattgataagataaaagaaagccaagaaggtgatgaatgtgttaagacggtgacagacatacaaggtggggatgtaagaaaggggtgctttatttttgagactttttctttagatgagattaaagaagaatctgactatatcagcaccaagaaaacaattactgaagaagtaatacagggtgatgtaaaaagctacagaatgctctttgaaacccagccactctatgcaattcaagaccgagaagggtcctatcatgaagtgaccacagttaaaaaagaagaggtaattcatggagatgtgcgaggaacaaggtggctttttgaaacaaagccattagactctattaataaatcagaaactgtgtatgttattaaatctgtcacacaagaagacattcagaagggagatgttagttctgtcagatacagatttgaaactcagccactggatcagatttctgaagaatcacataatattatgcccagtattgaccatatacaaggtggcaatgtaaagacaagtagacaattctttgagtctgaaaattttgataagaataactatatacgaacagtaagtgtcaatgaaatacaaaagggcaatgttaaaacatctacttggctatttgaaacccacactatggatgaactgagaggagaagggttagaatatgaaaatatcaagacagtcactcaggaagatgtgcagaaaggtgatgttaagcaggctgtgtggctttttgaaaatcgaactttcgattctattatggaagcacataaaggtatcacaaaaatgaccaaggaagaaatccctccttctgatgtcaaaacaaccacatggctctttgaaacaacaccacttcatgaatttaatgaaactagagtagaaaagatagaaattattggcaagagcattaaagaaaccttagaagatctctactctcaaaaagttatccaggctcctggaatcatcattgaagctgatgaaataggggatgttcgaatggcaaaatacaagctaatgaaccaagcatctcctgagatacagaaagaagaaattatcagggctgatctcagaaatataatggtgaacctactttccaaaagggactgtactgaaagagagattttgattagtgaagaagagaagggaaatgttaatttgactaaaactcaattattaaacagatcaactgaatttcatgctgaaaaagaagagatagtgaaaggtgatgtacaacaagcaataaaaaacctgttctctgaggaaagatctgtaaagaaaggcatcttaattcaggaagatgaaaaaggagatattaacatgactatctattgtcttcttcatgaaaatgatggtgacacaattgagcgtgaagaagtaataggtggtgatgtcaaacgtaccattcataatttattgtcttccacatcaaacaataaaatatctgaaagggctaaaattgatgcctctgagagaggaaatgttcagtttttcacaacctgcatagaagctggagctttggattatctgaaacaactccacacagagtcaaatgaaacactgacagctaagaaacaagaaggagagaaagaaatcattggtggtgatgttgaaggtacaaaactgttactgaagaaaaggcagtctctggttgaacgtactgttagtgaaactgacatcatccctggagatgtgcataacacagttaaggtttttatgaccgagcctcagagtacatttggtaagatacccaaagaagagattataaaaggtgatttgacatcaaccctaaattccctcagccaggctgtaaatcagaaaacagtgacgaaaacagaagaaattataaaaggtaacatgctagccacactcaagtcacttaaagaatcaagccatcgatggaaagaatctaaacagcctgatgccatccctggtgatattgaaaaagctattgaatgccttgaaaaagctacaaatacaaagacagaaattctgaaaaaggagcttctcaaagatgacctggaaacatcactaaggtctttgaaagaagcacaaagaagtttcaaagaggtacataaagaaggtgtaataaaaaaagatgctaaagctgtgatggcaggatcctcgggagagcagaaaacagatattcatcaggttgctgtccagaggaacaaaaatagtcttcttcagccaaagccaggtccatttgagccagcggccaagtggcaagggggagcagatactctcagtcaaactatggggaaatcttgccatggcaatttagtagaagaaagaactgaggttaatcttccaaaagcccccaaaggcactgtaaagattgtcatagatcgtgaacaaaacaatgatgctctggagaaaagccttagaagactatctaattcacaccataaatctaatgttttggaatcaggagacaaaacgggtgtctggactgatactacaggagaacagcatcttagagatgaatatatgagcagacaattaacttcaactgtgtcagttaagaataatctaacaactaaagaatcagacagggcagtgagagagctgaagaaggatgatgtctttaattccatccaatctgctggtaaaaccgttggaaagcaacagacatatgaactgagaaatgaccaccagaaaatggagggttttcatataaagagtcctaaaaagaccaaaaatattaaaatattaactgatacacaaagctccaagcccagtcccacccagcatccagtcagcatgccagttggaggaacttacgacctttcaggggactttcagaagcaaactttgttaaagcaagaaacaaaatattctaataaggatataaagaaaaagaatataaaccttcaaccaatgtggcagcttttgcctgtagagcaagacacatccaatgtaacagaaatgaaagtctctgaaaaaagtcacaatacatttaaggcaaccaacaaaaagcgggagactgatgttcacttgaaaagccaggactttctaatgaaaacaaatacttccacaggcttaaaaatggcaatggaaaggtccttgaatccaatcaactttaaccctgagaataatgtaaaagaaagtgagtgcccccttccacctccatctccacctcctccaccaccttctaatgcatcatctgaaattgaatttcctcttcctcctccacctcctttgatgatgtttcctgaaaaaaatgggtttcttccctcactgtccacagagaagataaaggctgaatttgaaagttttccaggcctccctcttcctccacctccagtagatgagaaatctgaaagagaaagttcatcgatgtttctgccgcctcctcctcctccaactccatctcaaaagccagcacatctcctttcctcctctgctccggaaaagcacagtggagacttcatgcaacaatattcccaaaaagaagcctcgaactctcagaattctcaggctaaaatcataacaggaaaaaccggtgtgttgccacctcccacattgcccaaacccaaacttcccaagcatataaaagataataagaacgatttttcccccaaagttgaactggcaacctccctgtcagatatggaatgtaaaattactacctcaaaggatcagaaaaaagtaatggtgatgaccagcagtgaacacacggagacaaagcagaacgttattagtaagagtcttgatgaaagaaaacaattatctattgactctgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaaaaagaagaaattgaaaaacagaaacaggagagttcttactacaacattgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacattttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaaccaaaa

SEQ ID NO: 34566 - DNA, 12269 bp, Homo sapiens
atacagagctcagttcctaaaaataggtgccaagttgcatcctttagacgctctgctaaaataaattcagccgtcccatctacttgcttgatagacccttcagtggagcgggcctccactgcacccattgctttcaggggactgggaaattggctgtacatgaaacaagggaggaagctagtctgtgaagaactataaagatatatgatatttccacaaacttggggttaaacctaaatatcataaaagcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagactgaaagtgaatatgaagagactttcaagccatcatcagttgtgagtacctcttccacttcttgcgtttcaaccagccagaggaaggaaacatcaactacaagatatagtgatcacagtgtcacttcctcaactctggcacaaattaatgctacttcttcaggaatgacagaagaatttcctcctcccccacctgacgtacttcaaacttcagtagatgtgacagcattttcccagtcccctgaactgcccagtcctcctagaagactaccagtccccaaagatgtatattccaagcaaagaaatttgtatgaattaaaccgtttatataaacacatccatcctgagttaagaaaaaacttagaaaaagattatatcagtgaagtttctgagattgtttctagtcaaatgaactcagggagttcagtctcagcagatgtgcaacaagcccggtatgtttttgaaaacacaaatgacagttctcaaaaagatctgaactcagaaagagaatacttggaatgggatgaaattctgaagggagaggtgcagtccattagatggatctttgagaatcaaccattggattccatcaacaatggctctcctgatgaaggtgatatttccaggggcattgctgatcaagaaatcattgctggtggtgatgtgaaatataccacatggatgtttgaaacccaacccatcgacacacttggggcttattcttctgacactgtagaaaatgcagagaaaattcctgagctagccagaggagatgtctgcacagctcggtggatgtttgaaacaaggccattggactcaatgaataaaatgcatcaaagtcaagaagaatcagcggtaactatcagtaaggacataactgggggggatgtcaagactgtgagatacatgtttgaaactcaacatctagatcaacttggacagcttcattcagtggatgaggttcatttactgcagcttaggtctgagctcaaagaaattaagggaaatgttaaaagaagtataaaatgtttcgaaactcaaccattatatgttattagagatggttcgggccaaatgctggaaattaaaactgttcacagagaagacgttgaaaagggagatgtaagaacagcacggtggatgtttgaaacacagccgttggacacaattaacaaagatatcacagaaattaaagttgtccgaggaatatccatggaagaaaatgtcaaaggtggggtgagtaaggcaaagtggttatttgaaacccaacctttggagaaaatcaaagagtcagaagaggtcatcattgaaaaggaaaaaataataggtacagatgtctccagaaagtgttggatgtttgaaacccagccattagacattctaaaagaagttcctgatgcagattctctacaacgtgaggagataataggtggtgatgtacaaactactaagcatctatttgaaacacttccaattgaagcattaaaagacagtcctgatataggaaagcttcaaaaaatcactgcctctgaagaagaaaaaggggatgttaggcatcaaaaatggatttttgaaacccaacctctggaagacattagaaaagataaaaaggagtacacacgaacagtgaaacttgaagaagttgacagaggagatgtgaagaattacacacatatctttgaatcaaacaatttaattaaatttgatgcatcacataaaatagaggtggaaggagttacaagaggtgctgtagagttaaataaatctctcttcgagacaacaccactgtatgccattcaagatccccttggaaaatatcatcaagtaaagacagtccagcaagaagaaatcgtaagaggtgatgtaagaagctgtaggtggctttttgaaacaaggcccattgaccagtttgatgaaagcattcataaatttcaaataattagaggaatatctgctcaagaaatacagactggaaatgtgaaatctgccaaatggttgtttgaaacccaacctcttgattcaattaaatattttagtgatgtggaagaaacagaaagtaaaactgaacaaactagagatattgttaaaggggatgtcaaaacctgtaaatggctttttgagacccagccaatggagtctctttatgaaaaagtttcgttaatgaccagcagtgaagaaattcataagggagatgtcaaaacttgtacttggctctttgaaactcagccacttgataccataaaagatgactctgaaacagcagtcaaattgcaaactgtaaaacaggaggagatccaaggtggggatgttcgtacagcatgttttctttttgagacagaaaatttggacagcatacaaggagaagaagtgaaggaaatcaagcctgttgaaatggatatacaagctggagatgtttccagcatgaggtataaatttgaaaatcagtccttagattctataagttctagttcagaggaagttttgaaaaagatcaaaaccttaaaaactgaagatattcagaaaggcaatgttttaaattgtaggtggctttttgaaaaccaaccaattgataagataaaagaaagccaagaaggtgatgaatgtgttaagacggtgacagacatacaaggtggggatgtaagaaaggggtgctttatttttgagactttttctttagatgagattaaagaagaatctgactatatcagcaccaagaaaacaattactgaagaagtaatacagggtgatgtaaaaagctacagaatgctctttgaaacccagccactctatgcaattcaagaccgagaagggtcctatcatgaagtgaccacagttaaaaaagaagaggtaattcatggagatgtgcgaggaacaaggtggctttttgaaacaaagccattagactctattaataaatcagaaactgtgtatgttattaaatctgtcacacaagaagacattcagaagggagatgttagttctgtcagatacagatttgaaactcagccactggatcagatttctgaagaatcacataatattatgcccagtattgaccatatacaaggtggcaatgtaaagacaagtagacaattctttgagtctgaaaattttgataagaataactatatacgaacagtaagtgtcaatgaaatacaaaagggcaatgttaaaacatctacttggctatttgaaacccacactatggatgaactgagaggagaagggttagaatatgaaaatatcaagacagtcactcaggaagatgtgcagaaaggtgatgttaagcaggctgtgtggctttttgaaaatcgaactttcgattctattatggaagcacataaaggtatcacaaaaatgaccaaggaagaaatccctccttctgatgtcaaaacaaccacatggctctttgaaacaacaccacttcatgaatttaatgaaactagagtagaaaagatagaaattattggcaagagcattaaagaaaccttagaagatctctactctcaaaaagttatccaggctcctggaatcatcattgaagctgatgaaataggggatgttcgaatggcaaaatacaagctaatgaaccaagcatctcctgagatacagaaagaagaaattatcagggctgatctcagaaatataatggtgaacctactttccaaaagggactgtactgaaagagagattttgattagtgaagaagagaagggaaatgttaatttgactaaaactcaattattaaacagatcaactgaatttcatgctgaaaaagaagagatagtgaaaggtgatgtacaacaagcaataaaaaacctgttctctgaggaaagatctgtaaagaaaggcatcttaattcaggaagatgaaaaaggagatattaacatgactatctattgtcttcttcatgaaaatgatggtgacacaattgagcgtgaagaagtaataggtggtgatgtcaaacgtaccattcataatttattgtcttccacatcaaacaataaaatatctgaaagggctaaaattgatgcctctgagagaggaaatgttcagtttttcacaacctgcatagaagctggagctttggattatctgaaacaactccacacagagtcaaatgaaacactgacagctaagaaacaagaaggagagaaagaaatcattggtggtgatgttgaaggtacaaaactgttactgaagaaaaggcagtctctggttgaacgtactgttagtgaaactgacatcatccctggagatgtgcataacacagttaaggtttttatgaccgagcctcagagtacatttggtaagatacccaaagaagagattataaaaggtgatttgacatcaaccctaaattccctcagccaggctgtaaatcagaaaacagtgacgaaaacagaagaaattataaaaggtaacatgctagccacactcaagtcacttaaagaatcaagccatcgatggaaagaatctaaacagcctgatgccatccctggtgatattgaaaaagctattgaatgccttgaaaaagctacaaatacaaagacagaaattctgaaaaaggagcttctcaaagatgacctggaaacatcactaaggtctttgaaagaagcacaaagaagtttcaaagaggtacataaagaaggtgtaataaaaaaagatgctaaagctgtgatggcaggatcctcgggagagcagaaaacagatattcatcaggttgctgtccagaggaacaaaaatagtcttcttcagccaaagccaggtccatttgagccagcggccaagtggcaagggggagcagatactctcagtcaaactatggggaaatcttgccatggcaatttagtagaagaaagaactgaggttaatcttccaaaagcccccaaaggcactgtaaagattgtcatagatcgtgaacaaaacaatgatgctctggagaaaagccttagaagactatctaattcacaccataaatctaatgttttggaatcaggagacaaaacgggtgtctggactgatactacaggagaacagcatcttagagatgaatatatgagcagacaattaacttcaactgtgtcagttaagaataatctaacaactaaagaatcagacagggcagtgagagagctgaagaaggatgatgtctttaattccatccaatctgctggtaaaaccgttggaaagcaacagacatatgaactgagaaatgaccaccagaaaatggagggttttcatataaagagtcctaaaaagaccaaaaatattaaaatattaactgatacacaaagctccaagcccagtcccacccagcatccagtcagcatgccagttggaggaacttacgacctttcaggggactttcagaagcaaactttgttaaagcaagaaacaaaatattctaataaggatataaagaaaaagaatataaaccttcaaccaatgtggcagcttttgcctgtagagcaagacacatccaatgtaacagaaatgaaagtctctgaaaaaagtcacaatacatttaaggcaaccaacaaaaagcgggagactgatgttcacttgaaaagccaggactttctaatgaaaacaaatacttccacaggcttaaaaatggcaatggaaaggtccttgaatccaatcaactttaaccctgagaataatgtaaaagaaagtgagtgcccccttccacctccatctccacctcctccaccaccttctaatgcatcatctgaaattgaatttcctcttcctcctccacctcctttgatgatgtttcctgaaaaaaatgggtttcttccctcactgtccacagagaagataaaggctgaatttgaaagttttccaggcctccctcttcctccacctccagtagatgagaaatctgaaagagaaagttcatcgatgtttctgccgcctcctcctcctccaactccatctcaaaagccagcacatctcctttcctcctctgctccggaaaagcacagtggagacttcatgcaacaatattcccaaaaagaagcctcgaactctcagaattctcaggctaaaatcataacaggaaaaaccggtgtgttgccacctcccacattgcccaaacccaaacttcccaagcatataaaagataataagaacgatttttcccccaaagttgaactggcaacctccctgtcagatatggaatgtaaaattactacctcaaaggatcagaaaaaagtaatggtgatgaccagcagtgaacacacggagacaaagcagaacgttattagtaagagtcttgatgaaagaaaacaattatctattgactctgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaaaaagaagaaattgaaaaacagaaacaggagagttcttactacaacattgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacattttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 34567 - DNA, 2890 bp, Homo sapiens
atacagagctcagttcctaaaaataggtgccaagttgcatcctttagacgctctgctaaaataaattcagccgtcccatctacttgcttgatagacccttcagtggagcgggcctccactgcacccattgctttcaggggactgggaaattggctgtacatgaaacaagggaggaagctagtctgtgaagaactataaagatatatgatatttccacaaacttggggttaaacctaaatatcataaaagcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 34568 - DNA, 3221 bp, Homo sapiens
gacaacctggacccatccatgttcccaatgcagaagggctccctcaacctcctgaggcagaaatgggaatcttgtgattatcagagaagtgagtgtcatcccagggacagccattgtacaattttccagcctcaggaaagcaaattgcttgcgcctgaaggagaggtagtatcagcacctcaatctttggatcccacaagtctgccctacagtacaggggaagagatgtggagttcgaagccggaagagaaggattctgtggacaagagtaacaacaccagggaatatggtcggccagaagtgctgaaggaggattccctgagcagtcggcgcaggattgaacgcttttccattgcccttgatgagctgaggagtgtgtttgaggctcctaagagtggaaacaaaccagctgagtacggtggaaaggaagtggaaattgagcgaagtttgtgctcgccagcttttaagagtcaccctgggagccagctggaggattctgtgaaagattcagacaagaaaggcaaggaaacatcttttgacaagatgtcacctgaaagtggtcacagccgcatctttgaagcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 34569 - DNA, 5246 bp, Homo sapiens
caagcatataaaagataataagaacgatttttcccccaaagttgaactggcaacctccctgtcagatatggaatgtaaaattactacctcaaaggatcagaaaaaagtaatggtgatgaccagcagtgaacacacggagacaaagcagaacgttattagtaagagtcttgatgaaagaaaacaattatctattgactctgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaatgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacattttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 34570 - DNA, 2916 bp, Homo sapiens
atgttcccaatgcagaagggctccctcaacctcctgaggcagaaatgggaatcttgtgattatcagagaagtgagtgtcatcccagggacagccattgtacaattttccagcctcaggaaagcaaattgcttgcgcctgaaggagaggtagtatcagcacctcaatctttggatcccacaagtctgccctacagtacaggggaagagatgtggagttcgaagccggaagagaaggattctgtggacaagagtaacaacaccagggaatatggtcggccagaagtgctgaaggaggattccctgagcagtcggcgcaggattgaacgcttttccattgcccttgatgagctgaggagtgtgtttgaggctcctaagagtggaaacaaaccagctgagtacggtggaaaggaagtggaaattgagcgaagtttgtgctcgccagcttttaagagtcaccctgggagccagctggaggattctgtgaaagattcagacaagaaaggcaaggaaacatcttttgacaagatgtcacctgaaagtggtcacagccgcatctttgaagcagtgttctccacggaccaagcccagattctcaggctccacctgcatccaaaattgacaaagacccccaagaacagcctcaaatcctcaacttatatttcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaa

SEQ ID NO: 34571 - DNA, 3391 bp, Homo sapiens
ggagaaatctggcaggtctctaggcagacaaaagggaacatctggtagggactgggacatgtagaaaaaaggacaacctggacccatccatgttcccaatgcagaagggctccctcaacctcctgaggcagaaatgggaatcttgtgattatcagagaagtgagtgtcatcccagggacagccattgtacaattttccagcctcaggaaagcaaattgcttgcgcctgaaggagaggtagtatcagcacctcaatctttggatcccacaagtctgccctacagtacaggggaagagatgtggagttcgaagccggaagagaaggattctgtggacaagagtaacaacaccagggaatatggtcggccagaagtgctgaaggaggattccctgagcagtcggcgcaggattgaacgcttttccattgcccttgatgagctgaggagtgtgtttgaggctcctaagagtggaaacaaaccagctgagtacggtggaaaggaagtggaaattgagcgaagtttgtgctcgccagcttttaagagtcaccctgggagccagctggaggattctgtgaaagattcagacaagaaaggcaaggaaacatcttttgacaagatgtcacctgaaagtggtcacagccgcatctttgaagcagtgttctccacggaccaagcccagattctcaggctccacctgcatccaaaattgacaaagacccccaagaacagcctcaaatcctcaacttatatttcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 34572 - DNA, 1690 bp, Homo sapiens
cttttgaaattctaaattctgatgcagaacgtatcagtgaaactccctcccactgtctcttgtattagcatcaaggaagcgagaaaaaataagcaccctgagaatggagacagtgtttgaagagatggatgaagaaagcacaggaggagtttcatcttcgaaagaagaaatagtccttggccagagactccatctaagctttccttttagcattatcttctcaactgttctctactgtggtgaggttgcctttggtttatacatgtttgaaatttatcgaaaagctaatgacacattctggatgtcatttaccatcagctttattattgtgggggcaattttggatcaaattatcctgatgtttttcaacaaagacttgaggagaaataaggctgcattacttttttggcacattcttcttttaggacctattgtgaggtgtttgcacaccattagaaattaccacaaatggttgaaaaatcttaaacaggagaaggaagagactcaagttagcatcacaaagagaaacacgatgctggaaagggagattgcattctcaatccgggataatttcatgcagcagaaggctttcaagtacatgtcagtgattcaggcttttctcggttctgttccacaattaattttgcagatgtatatcagtctcactatacgagaatggcctttgaatagagcattgctgatgacattttccctgttatcagttacttatggggccattcgctgcaatatactggccatccagatcagcaatgatgatactaccattaagctaccgccgatagaattcttctgtgtcgtgatgtggcgttttttggaggttatctcacgtgtagtgactctggcatttttcattgcatctctgaaactgaagagcctacccgttttgttaatcatatattttgtatcattgttggcaccgtggctggagttttggaaaagtggagctcatcttcctggcaacaaagaaaataattccaatatggtgggtacagtactgatgcttttcttgatcacactgctatatgctgccatcaacttctcctgctggtcagcagtgaaactgcagttgtcagatgacaaaataattgacgggagacagaggtggggccatagaatcctacactacagctttcagtttttagaaaatgtgataatgatattggtatttaggttctttggagggaaaactttgctgaattgttgtgactcattaattgccgtgcagctcatcataagctacctattggccactggctttatgctcctcttctatcagtatttgtacccatggcagtcaggcaaagtgttgccaggacgtactgaaaatcagccagaagcaccgtactattatgtaaacatcgagaaaactgaaaagaataaaaataagcagctgaggaattactgtcactcctgcaatagggttggatatttttcaatcagaaaaagtatgacatgttcataaaatatacatatatactttcacagaacaatgagtaaagatgctgaatgtgacttgttaagaggctcttaaatttaaaaaatatacacagcaaaatcttggaagtggtttctaataaaattcatttatgttctcctgtgaacgtgccttagtaatttttgttttcttaactataattatacaattcattaaataaaacaaaataaaaaa

SEQ ID NO: 34573 - DNA, 2851 bp, Homo sapiens
ctgagagcgcgcaggtgagcgggccagctgatagctacagcctagcaatagctaggatacctaggcactgaactgaatcccctcttctgccctccttcttctgcgcccgctcttctgccctggctcagctctccgctgacttgagaggacacactggtcaggactctttgtgaggagctgctgagtgtcggtgcccccgacagatcggctacaccctgcctgaggggctgcgaaaggagccgccacggaagccgctgttctcatgactcttcacgtccctggagttggactctggatggggcgctgggatgcttgcttttgtcttgttcaagtttcacagcaagtatgttgacgattggaatcggggccaatcaagagtcaagttcaaagtggtactcctgggctttccatcccagactccaagtcgaatctgagtctagaagagagcggtttcttgctctaactagtgaatctctgttcccaaactggacttgacagagctctcctcacctatacttggactgtagcggccatagggttctcttggggatgggtgggagggtgctatgaacacaagaccacaacattcagaaagaacctcgacaatggacagagtttatgaaattcctgaggagccaaatgtggatccggtttcatctctggaggaagatgtcatccgtggagccaacccccgatttacttttccatttagcatccttttctccacctttttgtactgtggggaggctgcatctgctttgtacatggttagaatctatcgaaagaatagtgaaacttactggatgacatacaccttttctttctttatgttttcatccattatggtccagttgaccctcatttttgtccacagagatctagccaaagataaaccgctatcattatttatgcatctaatcctcttgggacctgttatcagatgtttggaggccatgattaagtacctcacactgtggaagaaagaggagcaggaggagccctatgtcagcctcacccgaaagaagatgctaatagatggcgaggaggtgctgatagaatgggaggtgggccactccatccggaccctggctatgcaccgcaatgcctacaaacgtatgtcacagatccaagccttcctgggctcagtgccccagctgacctatcagctctatgtgagcctgatctctgcagaggttcccctgggtagagttgtgctaatggtattttccctggtatctgtcacctatggggccaccctttgcaatatgttggctatccagatcaagtacgatgactacaagattcgccttgggccactagaagtcctctgcatcaccatctggcggacattggagatcacttcccgcctcctgattctggtgctcttctcagccactttgaaattgaaggctgtgcccttcctagtgctcaacttcctgatcatcctctttgagccctggattaagttctggagaagtggtgcccagatgcccaataacattgagaaaaacttcagccgggtcggcactctggtggtcctgatttcagtcaccatcctctatgctggcatcaacttctcttgctggtcagctttgcagttgaggttggcagacagagatctcgtcgacaaagggcagaactggggacatatgggcctgcactatagtgtgaggttggtagagaatgtgatcatggtcttggtttttaagttctttggagtgaaagtgttactgaattactgtcattccttgattgccttgcagctcattattgcttatctgatttccattggcttcatgctccttttcttccagtacttgcatccattgcgctcactcttcacccataatgtagtagactacctccattgtgtctgctgtcaccagcaccctcggaccagggttgagaactcagagccaccctttgagactgaagcaaggcaaagtgttgtctgattctattttctgggtattttaggaagagttgggagttgccaagagtaaccatgaaattgaacgaaaggatgaggttcatgggtgagatacccatcagtacattttcttgacttttctgttaagcctatcagaagaaagagcaactcccaaataggttttattttcttaagagttaccactatgtttggaaacagggggtatcgactatatagttgaaagggtcagaaataccattcacacccttcttacccaagtcaattggaataacttgtcttcaaacactttaggctctctaaagtgaccttctagctctgctcatttgcttgatgcatttctgagctttcctgggctgagctgaaggcccagaatcccgctagaatatatcctgactgatcagaggatatgacagcttaccagctaagagtacctcccaggaaacagtctgactaatgtggaacctgcaactgtcagtgtggctggggtctttttaattccagtgagaagctctggctgagaagaaaatcaccactattaaaaaagctgctccccaagcagattagctctctgttaggattttactagtggccattcagcaaggacctctctttacagtggcacttcataggcacactctaaggagaaagtgcagagtagaattccttcagggcataagccaaaatgactctttttctcagggacctgcatgggcctccagcttgtctattggaattgttaagtgaagcctctcacttagtgcctcattagcagagatttcctccaacccagcttttctgtgctcttggtattttactacttgatgtggacctcagagaagctgaactgtaattgaaaatgtttccgatgtgtggaagaaatgaagactgctttgtgtctgc

SEQ ID NO: 34574 - DNA, 2848 bp, Homo sapiens
ctgagagcgcgcaggtgagcgggccagctgatagctacagcctagcaatagctaggatacctaggcactgaactgaatcccctcttctgccctccttcttctgcgcccgctcttctgccctggctcagctctccgctgacttgagaggacacactggtcaggactctttgtgaggagctgctgagtgtcggtgcccccgacagatcggctacaccctgcctgaggggctgcgaaaggagccgccacggaagccgctgttctcatgactcttcacgtccctggagttggactctggatggggcgctgggatgcttgcttttgtcttgttcaagtttcacagcaagtatgttgacgattggaatcggggccaatcaagagtcaagttcaaagtggtactcctgggctttccatcccagactccaagtcgaatctgagtctagaagagagcggtttcttgctctaactagtgaatctctgttcccaaactggacttgacagagctctcctcacctatacttggactgtagcggccatagggttctcttggggatgggtgggagggtgctatgaacacaagaccacaacattcagaaagaacctcgacaatggacagagtttatgaaattcctgaggagccaaatgtggatccggtttcatctctggaggaagatgtcatccgtggagccaacccccgatttacttttccatttagcatccttttctccacctttttgtactgtggggaggctgcatctgctttgtacatggttagaatctatcgaaagaatagtgaaacttactggatgacatacaccttttctttctttatgttttcatccattatggtccagttgaccctcatttttgtccacagagatctagccaaagataaaccgctatcattatttatgcatctaatcctcttgggacctgttatcagatgtttggaggccatgattaagtacctcacactgtggaagaaagaggagcaggaggagccctatgtcagcctcacccgaaagaagatgctaatagatggcgaggaggtgctgatagaatgggaggtgggccactccatccggaccctggctatgcaccgcaatgcctacaaacgtatgtcacagatccaagccttcctgggctcagtgccccagctgacctatcagctctatgtgagcctgatctctgcagaggttcccctgggtagagttgtgctaatggtattttccctggtatctgtcacctatggggccaccctttgcaatatgttggctatccagatcaagtacgatgactacaagattcgccttgggccactagaagtcctctgcatcaccatctggcggacattggagatcacttcccgcctcctgattctggtgctcttctcagccactttgaaattgaaggctgtgcccttcctagtgctcaacttcctgatcatcctctttgagccctggattaagttctggagaagtggtgcccagatgcccaataacattgagaaaaacttcagccgggtcggcactctggtggtcctgatttcagtcaccatcctctatgctggcatcaacttctcttgctggtcagctttgcagttgaggttggcagacagagatctcgtcgacaaagggcagaactggggacatatgggcctgcactatagtgtgaggttggtagagaatgtgatcatggtcttggtttttaagttctttggagtgaaagtgttactgaattactgtcattccttgattgccttgcagctcattattgcttatctgatttccattggcttcatgctccttttcttccagtacttgcatccattgcgctcactcttcacccataatgtagtagactacctccattgtgtctgctgtcaccagcaccctcggaccagggttgagaactcagagccaccctttgagactgaagcaaggcaaagtgttgtctgattctattttctgggtattttaggaagagttgggagttgccaagagtaaccatgaaattgaacgaaaggatgaggttcatgggtgagatacccatcagtacattttcttgacttttctgttaagcctatcagaagaaagagcaactcccaaataggttttattttcttaagagttaccactatgtttggaaacagggggtatcgactatatagttgaaagggtcagaaataccattcacacccttcttacccaagtcaattggaataacttgtcttcaaacactttaggctctctaaagtgaccttctagctctgctcatttgcttgatgcatttctgagctttcctgggctgagctgaaggcccagaatcccgctagaatatatcctgactgatcagaggatatgacagcttaccagctaagagtacctcccaggaaacagtctgactaatgtggaacctgcaactgtcagtgtggctggggtctttttaattccagtgagaagctctggctgagaagaaaatcaccactattaaaaaagctgctccccaagcagattagctctctgttaggattttactagtggccattcagcaaggacctctctttacagtggcacttcataggcacactctaaggagaaagtgcagagtagaattccttcagggcataagccaaaatgactctttttctcagggacctgcatgggcctccagcttgtctattggaattgttaagtgaagcctctcacttagtgcctcattagcagagatttcctccaacccagcttttctgtgctcttggtattttactacttgatgtggacctcagagaagctgaactgtaattgaaaatgtttccgatgtgtggaagaaatgaagactgctttgtgtc

SEQ ID NO: 34575 - DNA, 5206 bp, Homo sapiens
ccaggtcggccgcccccaccaggtccagttccagagcccaggccggtcggccgggcccgcgtgccctcggcgggctgcgcagagcgcgggagcggtttggggctgggcatgctgggagcccctcgggcaacggccgccgccgccacagccacacagccgccgccactgcgtccgtccccggtgagcgccgctgacgcgcggagatgaaattcccggcctcggtgctggcgtccgtgttcctgttcgtggccgagacaacggcggcgctcagcctgagcagcacctaccgctcgggcggggaccgcatgtggcaggcgctgacgttgcttttctcgctactgccttgcgcgctcgtgcagctcacgcttctcttcgtacaccgcgacctcagccgcgaccgcccgctcgtactgctgctgcacctgctgcaacttgggccccttttcaggtgttttgaagtcttctgcatctactttcagtcaggcaacaatgaagagccttatgtcagtatcaccaagaagaggcaaatgccaaaaaatggcctctcagaggagattgagaaggaggtgggccaggcagaaggcaaactaatcacccaccgatcagcgttcagccgggcgtcggtgatccaggctttcttgggctcagccccccagctgaccctacagctgtacataagtgtcatgcagcaggacgtcactgttggaagaagtctcctcatgaccatatccctgttgtccattgtgtatggagccttgcgctgcaacatcctagccatcaaaatcaagtacgatgagtatgaagtcaaagtgaagcctctggcctatgtctgtatcttcctgtggaggagctttgagattgccactcgagttgtagtcctggtcctctttacctccgtcctgaagacctgggtggtggttataatactcatcaacttcttcagtttcttcttgtacccctggatcctcttctggtgcagtggttccccattccctgagaacatagagaaggccctcagtagagtgggcaccaccattgtactatgctttctaactttactctatactggtatcaacatgttctgctggtctgctgtacagctgaaaattgacagccctgacctcatcagcaagtcccataattggtaccagctactggtgtattacatgataagattcatcgagaatgccatcctcctcctcctgtggtatcttttcaagactgacatctatatgtatgtgtgcgcacctctgttggtcctgcagctgctcattgggtactgcacagccattctcttcatgcttgtattctatcagttcttccacccttgcaaaaagctcttttcttccagtgtttctgaaggctttcagaggtggctcaggtgtttttgctgggcctgcaggcagcaaaaaccctgtgagccgataggaaaggaagatctacagtcatccagagatagagatgagacaccttctagcagtaaaacaagtcctgagcctggtcagttcttgaatgctgaagatctctgctctgcttaatgggacccaaggtctcagagcacaggcatattattttctgggtttgatactcgttattcatacaaataatgagccctacacagggaacaaggcaggaagttagctgttaactccttgtgagctgcttctctttatagagctcttgggtatgtagaactgtatgggaagaagccaggaaaacctctgagtgttgaaggggcaacccaaggcatcacagttcacaggtaaccatgttgtgttcttctaggcattactggccttttcactgacaagttacccctgaaatctgagttgtactggttagattcattaggttgaatgaggagaggggcttacctgttctctagttttccagactgctggtttgggtaacctgaagttttatgatccctgaacatagttttcacccaagagctgtcctggtgaccaaaaaagattactagggttttgccatcagcaacatcattcctgtcagagctttcagggagggctgttcaagtttggtttttgaatagacagaggtttcattttcatctcattagggcttttttgtacatagccaactgtagccaccctggcatgctgtctctaattgattcaagggcctagatttggagactttgttccttagcatccatggatgcagaaatgagtgataaatttggccatgaaagccctggaattttaggaaagttgtgattctttgatatgttgatgaaattctggatcaggaggggtgttaaaacatcaaaatgatggcgacttgtataagtagaattcttaccatcttactcctgcctccccattccttgcctgtcaggaccattttagaagagttaccttggttaacttaagggttttttagaaaaccccacagaaatctctcacccagttcaggtgtatagggaattttcattttcattatttcaaggaatagagttttcctcactaccacttgtaattagagattgacttcagaaactttttctaaattataaagacggaatgaccagaaaatttttgtctttcatggaatgcaatttgacttggcataattgtgagttaatttgataaagatctccagttgtatcctctgacaccctttaatgttctatataatttttcctttaatcggagaccctatttgtttcattaaagaggattgggtagcatatcctcaattatcttggaaaaatgcgtagatctagtgccattatttctaccattaaaatcttgaaagcgaaatacttgaaaagaggtgaccataaagatcacaccaatttagaatgaatattaaagtctgagaaatttacaaaagggactctatggactcgattttaccatatggaatagggatccacttctctgttaacctacaaaacgtatttatctggccattgcacttcggataattttcatttttaattcctcttggtgtcaaatttttaagtaatttcatgcacacaggagaaaatgcaatttgataatcagtttccactacattcggaggtcaagaaagcagtatatattctttcacaaggcatccatactgtttaatatttatagagttcatagaaatacatcaataagctcctaaattatagagcctcaattttggtttttctcatttgaaatgtttttgatttatcaatatttgtggtttaactttgtgggggtgtccaggcagtagatcattttttgtctatttttaaccaaataagaataacactcaagactatgttctccatcccaacacatcacttaccacttgcactattcttaataggcctaaaatagtgagcatatataatcaaaataatacttcatacaacatatacttccatgcactcttcatgtaatcacatatgtgcatagatacacaatcgtattacataaaacacccttgaaaatatatgactttgaataaaataaagctaccatgttaatacatcattttttgtttcttcctaattaacaaaagggctctataatgattaggagagctgtaaggccattctttagtcattccaagtgtatatttgtatcacaccagttacttgtgttcattgacaccaaatattttcaagctttttgtgagaaagagattcttgccttgaggctctgcagtggcaaatggtaggggcaatagcgctcccttttcacctgaaatgccttcagctcaggccttgggagtgaggtgtgggagtagccaccagcctcccactgactaggcatgttaggaattagacaaggatggagagactggttttttccagccttggtttggaagcttgtctcaaaaaccattacaaaatcttaaccttcaaatacattctaaatcactttaatttagaagataggtgagcaacttgagtgatcccaaaccaaactaacagtgctggtttgtccgacacccaaagcccacttcacacatttataaggacagagatttggtaactcatttgggtattttgtcagttttaacccttaatatacaggtatcccagctttgggcacatgtatgtccattcactttcaggaaggggtgtcagtactttctttctgtgtggtgaaaacataagccatggtgaactgataatttttgtttttaaattatttatattactgaattggcaaaattacagttcacactgcagagctaggttgtcctattggcataaaacaaaccagcaacttttctcatgtgtttggagttaaaatgtgtttttcagttataatttcaatttttaaatttcttggtgctttgtctaattaattacatcccataacttgtcaggatagttgctccaactgaattgctatcatttggctggatgggggtgaagtatgtcttcaaaatatattgaagtaagttcatcaaacatgtttagacttcctctcattgctggagacagcccagtgtagagattggcacttccctgtccagcactacaacttaattgctctatgcctcagtttccccataatacccttttccaacctacctcacaaggttatcagaaagatcaaattaaataatagatgtgaaaatgctttgaaaatgtttttaagtgctatgcatatttatagagttattatagttattcaaatccataagcaggttatttttatttttttactgtttgaaaagaaataagtagtgtcattcatatgagttcctgagtggatatgcgaatctttggtcttctcgacaggtgccctttctcttaccactagttgcttacaaaaatagcacccaaacacatggcacttggaagaaaaagacccactgaatctgagaaagtactttctggtggcaaatgaatttatcattttagtatagttttcgataaaggatatagcaacatcttttgataattgtgctttacaacttgaatgctgattcaaggcattatttggatgtgagtttaatcttttcagccttgtaaatgggaaaatatatattaaaattgattgtcaaatacagcatttctttggaaaccaccttaaaacattagtgctatggttatgagtgtatgtgccagtacttaccagtcaatgcattgtggatatgagctttcgttgactgcttctctgcagtcgttgatgctaataaatattgtcctgtttcttcatataataaattaatttttcaatttctccttgta

SEQ ID NO: 34576 - DNA, 2467 bp, Homo sapiens
gacccggcgctagcccgcccgcccgcccgccggctctcgcgcctccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 34577 - DNA, 2539 bp, Homo sapiens
gacccggcgctagcccgcccgcccgcccgccggctctcgcgcctccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 34578 - DNA, 2344 bp, Homo sapiens
ctccttcgcgccggcccttccgcgggtgatcagctggtctgcgctcccctgacgtgggctggggcacgtcaccgccgaatggcagcctccagaaagccaccgcgagtaagacggcagaatgcctccaaaggtgacttcagagctgcttcggcagctgagacaagccatgaggaactctgagtatgtgaccgaaccgatccaggcctacatcatcccatcgggagatgctcatcaggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 34579 - DNA, 1006 bp, Homo sapiens
gcgggtgatcagctggtctgcgctcccctgacgtgggctggggcacgtcaccgccgaatggcagcctccagaaagccaccgcgagtaagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatcccc

SEQ ID NO: 34580 - DNA, 2539 bp, Homo sapiens; identical to SEQ ID NO: 34577

SEQ ID NO: 34581 - DNA, 912 bp, Homo sapiens
cttgcacagtccgcctcgggcagcccaaagctcctctgcccaccctggctcccagagccctccaaaacaaaagaccagagaagcactctccacccagcagccagacgcctccttcttgacgccagcccccaccctctgtctgctcgagcccaggaaaggcctgaaggaagaggccggggaaagagccctccctctctcccttgtccctccatccacccagcgccggcatctggagaccctatggcccgggctcactggggctgctgcccctggctggtcctcctctgtgcttgtgcctggggccacacaaagccagtggaccttggagggcaggatgtgagaaactgttccaccaaccccccttaccttccagttactgtggtcaataccacaatgtcactcacagccctccgccagcagatgcagacccagaatctctcagcctacatcatcccaggcacagatgctcacatgaacgagtacatcggccaacatgacgagaggcgtgcgtggattacaggctttacagggtctgcaggaactgcagtggtgactatgaagaaagcagctgtctggaccgacagtcgctactggactcaggctgagcggcagatggactgcaactgggagctccataaggaagttggcaccactcctattgtcacctggctcctcaccgagattcctgctggagggcgtgtgggttttgaccccttcctcttgtccattggtatgctcttccttcagtccctgaatttgtccatgctaacgagggtgactcagcttccctaggatataaagaaatggaccttggtagaaggaggggcggtgggactataaagatagagcatttgaaattgtagttgcagaatgttttgcaatgaggatgtattcatggattgtgtaattaaa

SEQ ID NO: 34582 - DNA, 3270 bp, Homo sapiens
ctcccagagccctccaaaacaaaagaccagagaagcactctccacccagcagccagacgcctccttcttgacgccagcccccaccctctgtctgctcgagcccaggaaaggcctgaaggaagaggccggggaaagagccctccctctctcccttgtccctccatccacccagcgccggcatctggagaccctatggcccgggctcactggggctgctgcccctggctggtcctcctctgtgcttgtgcctggggccacacaaagccagtggaccttggagggcaggatgtgagaaactgttccaccaaccccccttaccttccagttactgtggtcaataccacaatgtcactcacagccctccgccagcagatgcagacccagaatctctcagcctacatcatcccaggcacagatgctcacatgaacgagtacatcggccaacatgacgagaggcgtgcgtggattacaggctttacagggtctgcaggaactgcagtggtgactatgaagaaagcagctgtctggaccgacagtcgctactggactcaggctgagcggcagatggactgcaactgggagctccataaggaagttggcaccactcctattgtcacctggctcctcaccgagattcctgctggagggcgtgtgggttttgaccccttcctcttgtccattgacacctgggagagttatgatctggccctccaaggctctaacagacagctggtgtccatcacaaccaatcttgtggacctggtatggggatcagagaggccaccggttccaaatcaacccatttatgccctgcaggaggcattcacagggagcacttggcaggagaaagtatctggcgtccgaagccagatgcagaagcatcaaaaggtcccgactgccgtccttctgtcggcgcttgaggagacggcctggctcttcaaccttcgagccagtgacatcccctataaccccttcttctattcctacacgctgctcacagactcttctattaggttgtttgcaaacaagagtcgctttagctccgaaaccttgagctatctgaactccagttgcacaggccccatgtgtgtgcaaatcgaggattacagccaagttcgtgacagcatccaggcctactcattgggagatgtgaggatctggattgggaccagctataccatgtatgggatctatgaaatgatacccaaggagaaactcgtgacagacacctactccccagtgatgatgaccaaggcagtgaagaacagcaaggagcaggccctcctcaaggccagccacgtgcgggacgctgtggctgtgatccggtacttggtctggctggagaagaacgtgcccaaaggcacagtggatgagttctcgggggcagagatcgtggacaagttccgaggagaagaacagttctcctccggacccagttttgaaaccatctctgctagtggtctgaatgctgccctggcccactacagcccgaccaaggagctgaaccgcaagctgtcctcagatgagatgtacctgctggactctggggggcagtactgggacgggaccacagacatcaccagaacagtccactggggcaccccctctgccttccagaaggaggcatacacccgtgtgctgataggaaatattgacctgtccaggctcatctttcccgctgctacatcagggcgaatggtggaggcctttgcccgcagagccttgtgggatgctggtctcaattatggtcatgggacaggccacggcattggcaacttcctgtgtgtgcatgagtggccagtgggattccagtccaacaacatcgctatggccaagggcatgttcacttccattgaacctggttactataaggatggagaatttgggatccgtctcgaagatgtggctctcgtggtagaagcaaagaccaagtacccagggagctacctgacctttgaagtggtatcatttgtgccctatgaccggaacctcatcgatgtcagcctgctgtctcccgagcatctccagtacctgaatcgctactaccagaccatccgggagaaggtgggtccagagctgcagaggcgccagctactagaggagttcgagtggcttcaacagcacacagagcccctggccgccagggccccagacaccgcctcctgggcctctgtgttagtggtctccacccttgccatccttggctggagtgtctagaggctccagactctcctgttaaccctccatctagatggggggctcccttgcttagctcccctcaccctgcactgaacataccccaagagcccctgctggcccattgcctagaaacctttgcattcatcctccttctccaagacctatggagaaggtcccaggccccaggaacacagggcttcttggccccagatggcacctccctgcaccccggggttgtataccacaccctgggcccctaatcccaggccccgagataggaaagccagctagtctcttctcttctgtgatctcagtaggcctaacctataacctagcacagactgctacagctgctcccctcccgccaaacaaaaccccaagagagcaatgcccctaccacccaagggtgccatggtcccgggagagcccaaacctatcaccacctgttgggcatagccagagctgttcccacccagccagggcatgaaacatcaaccccccacatgtgaacccatcattcctaaaccctgggtaggctccatgccaagtaacagcagagggagttaagccataggaatttggctgtggagtaagagggaatgcggtgaggcactctggaatatgaccctaccagaggttggagaacaaacttgggcagccggaacccgtcactattctagacttccctggcattcgaggagccctttgaactttccaaagtgcagccacagctacaatgctgttaaatcctcccacattcttggatgccccttcaccttgtgtggacagtgtctggtttctccattttacagacaggaaaactgagcttcagacagggggtgggctttgcctaaggacacacaaatttggttgggagttgatggggccagatgagccagcattccagctctttcacccttcagcaacatgcagagtccctgagcccacctcccagccctctcctcattctctgaacccactgtggtgagaagaatttgctccggccaaattggccgttagccacctgggtccacatcctgctaagacgtttaaaacagcctaacaaagaca

SEQ ID NO: 34583 - DNA, 7988 bp, Homo sapiens
ggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacaggctttcatagaaaccatgttcaccagtaaagcccctgtggaagaagcctttctttatgctaagtttgaatttgaatgccgggctcgtggcgcagacattttagcctatccacctgtggtggctggtggtaatcggtcaaacactttgcactatgtgaaaaataatcaactcatcaaggatggggaaatggtgcttctggatggaggttgtgagtcttcctgctatgtgagtgacatcacacgtacgtggccagtcaatggcaggttcaccgcacctcaggcagaactctatgaagccgttctagagatccaaagagattgtttggccctctgcttccctgggacaagcttggagaacatctacagcatgatgctgaccctgataggacagaagcttaaagacttggggatcatgaagaacattaaggaaaataatgccttcaaggctgctcgaaaatactgtcctcatcatgttggccactacctcgggatggatgtccatgacactccagacatgccccgttccctccctctgcagcctgggatggtaatcacaattgagcccggcatttatattccagaggatgacaaagatgccccagagaagtttcggggtcttggtgtacgaattgaggatgatgtagtggtgactcaggactcacctctcatcctttctgcagactgtcccaaagagatgaatgacattgaacagatatgcagccaggcttcttgaccttcactgcggcccacatgcacctcaggttcaaaatgggtgtcttctggcagccctgcacgtgtgctttctgagtgtctctgtgtgtgcattaatatatgcattccatttgggagcatagcagctgtgtgaatgtatgtaattgtgtgtggggggttttttgttttaagtagttagaagtctgggaaaatgaatttttgaatagtatgttactgcagctttggtaacattaattctatagaattaatgatcagagcaagtttaatttttaaacataaaggtcttggttacacatgtccatgcattccagttaacacatttaaacatatagaaaattcacttcttctttcaagtccttccctttctatacttttgctgagatcaacccaatatcataagaagtttgtgtgatgcctgtatttttagctaattaccaaggtctctgcctatgcaaaaattcatctttcggtgattgtgggcggccaatacataccttctgtaactcctccctacctattctagatcctgcatatctactggagccatatgagccctcaggggcactggtgtcctgcagtcttactagtcagccacagtccaggttccagcaacactagctacctaccaaacaaaacacttctgagcttttcttgccatttggttgcctgggacctggaaagtgtttagattcttgataaagatggaaatggaagagaaagaaaattatatatgtatatactaaagatccagacatcagggctgggcacagcggttccgcctgtaatcccagcactttgggaggtccaggcaggtggatctcttgagaccaggaggtcaagaccagcctggccaacgtggtgaaacactgtctctactaaaaatacaaaaatgagctgggtgtgatgatacatgcctgtaatcctggctacttgggaggctgaggcatgagaattgcttgaacctgggaggtggaggttgcagtgagctgagctcatgcgactgcactccagcctgggtgactgagcaagactctgcctcaaaaaaacaaataaataaataaaatcctgacatcctgccatcttttctcttcaatttaaagttgatttcttaatgatgacttcaaaaattaataaaaagaaaagaaaaaaatgatttctggccgggcgtggtggctcaagcctgtaatcccagcactttgggaggccgaggtgggcggatcacgaggtcaggagattgagacctcctggctaacacggtgaaaccccgtctttactaaaaatacaaaaaaaattagctgggcgtggtggcggatgcctgtagtcccagctactcaggaggctgaggcaggagaatggcgtgaacccagaaggcagagcttgcagtgagccaagatcgcgccactgcactccagcctgggtgacagagcgagactccgtctcaaaaaaaaaaaaaaaaaagaaaaaaaaaagaaagatttctttcgcagatatccctgctccctctatagattcttaatgcactgaccctcacaggttacccttttagctgttgtgctgcgcaggagcagatcctctacttacgtaccctgtcagagtcacagtagtagcgcccagttttcagagaagtacccctgttatcattctgtgatttcctctagtgctaatagaaacaaaatatggaatctaccaagtacccgtaaatatcctatgattcttatctttctttgatactagcactgggagtgcagtggtaaagagtcatacttcttttttttttttttttttggagacagagtctcgctctgtcgcctgggctggatggagtgcagtggcgtaatctcagctcactacaacctccaccacctgggttcaggcaattctcctgcctcagcctcccaagtaactgggactacaggtgcacgctgccatgcccagctaattttttgtattttagtagagacagggtttcaccctgttgcccaggccggtctcaaactcctgagctccggcaatccgcccacctcagcctcccaaagtgctaggattacaggcatgagccactgcgcccggtgtaagagtcatatttttttaaacacaaacattggatacaattatacagcaactcagtttgcaagatgaacagggctagattaccacagatagcttatttaggagcgtctgtgatagagggaagctttaagaaccagtgtgttcacctcctttaaacctggatatgaggtcaagatgtataaaacatgccaattgttagaacacaaatttgagggtttcttaaaaaaacaatttgtattagggaagcacaagctaggggattaacaatctctgtaatgctggaagtttgcctatcttatcagggaaacccagggtacagagtgaaaagcagacaggcagtgacttcctcaagagacagataatgtgaaaacaaaagtgatacaaatcatatcctgacagtgctagcctaggaatgcctggctttgcgcaccttatctaagcagctctcagaatggaggctgcacagctggagtctccatcccccatacccaccttcccacctccctccaatttctcaatccagagctttttaaaaaaaggggagggaaataactccacagctctggctgctcacttcccaggctctgtgcccccaacagccctttccttggattgtgtttcctttgttcatttgtaatccaggaataaggaatttccttttcttcttgtatcattttcttttcttttctttttttttttttttttgagacggagtctcacactgtcaccggggctggtgtgcaatagcgagacctcagctccctgcaacctccatctcccaggttcaagcgattctcctgcctcagcctcccgaatagctaggaatacaggcgcctgccaccacacccggctatttttttgtattttaaatagagacgaggtttcactgtgttggccaggctggtctcgaactcctgacctcatgatctgcccgcctcggcctccctaagtgctgcgattacagacgtgagccaccgcacctcctgtatcattttctatggtctaaacttttctagctaaaagcctaggtagcttgtatgtatagcagcatacttggacatgaaacacacttctggttagattccagtcaagttctataggtgttattggtaggcagaaaggctgttgtagaattcttctggtgattttcagtccctgacccaggtatattgtcctttgagtcccagattaactaactatagcagctaagcatttgaatcagacttctcatagcaatgttatgggctgtctgatatattcaggatttgttgagcagataagctgtgtgtgatcttactcattctcagccatgccgcagacatacccatttccctttagtaattttttaatacagagaatgctattaactgttactggatatcaaataattttatttttctaatagtattttccaaatatttcttaaaattcttaaaatttaggttaaagtttgctggtctcttacatttaataaagctgggacttgaagacttaccatagttttcaactgcctttgcaagttcataaacttctaagggtaaaaagtgaataagataaattcagagttttaaggtaaaggctttatattagctttttttttttttaaaggttttttgtggggtttttttgttttttttttttttgagatggagtctcgctctgtcacccaggctggagtgcagtggcacgatcttggctcactgcaacctccatctcccgggttcaggcaattcttctgcctcagcctcctgagtagctgggactacaggcgcgtgccaccatgcccggctagtttattgtatttttagtagagatggggttttactgtgttagccaggatggtctcaatctcctgacctcataatctgcccacctcagcctcccaaagtgctgggattacaggcgtgagccactgcacccagcctttttaaagtttttaattgacatataattgtacgtatttacagggtaaataatgatgttttgatacatatataatgatcagatcagaacaattagcatatccatcacattgaacatttatcatttatttgtgttgagcctttagttcttttttttttttgagatagagtctcactctgtcacccaggctggagtacagtggtgtgatcttggctcactgcaacctccacccaccggcttcaaccaattctcctgcctcagcctccctagtaactgggattacaggcacctgccaccacacccaatttttgtatttttagtagagacggggtttcaccatcttggccaggccaggctggtcttgatctcctgaccttgtgatccacccacctcagcttcccaaactgctgggattacaggcatgagccacggcccccagccagagacagtcttgctttgtcgccaggctggagtgtagtggcgccatcttggctcactgcaacctccaactccctggttcaagcagttctcctgcctcagcctcccaagtagctgggattacaggcacgcaccaccatgcccagctaatttttgtatttttagtagagacagggtttcaccatgttggccaggatggtcttgatctcctgacctcgtgatctgcccactttggcctcccaaagtgctgggattacaggtgtgagccaccgtgcccagccgagcctttagttctaagtataataaataatatatataccaggcattcctattaaaaatcttaacttaaaaaaaattactcaaatgttactactggaatttttctccctgaattgaagatacatggttagatcattaacaataccacctaaatgaaggaaacatatctggatatccagtgtcacatacttttatgtatttatttcaggaattactattttgtcaccataattaggaaacagactgtgttctttatttgaaacacaacagtataaatactatagtaaagttgggtgcagtggatcacagctataatcccagcactttgggagaccaaggagggatggtcacttgagcccaggagtttgagaccagcctaggcaacatagagagaccttgtctcaacaaaaaaatttaaagttagccaggtgtggtggtttgcacctatagtcccagctactcaggaggctgaggtgggaggatcgcttgagcttaggaggtcaaggctgcagtgagccatgattgtgccacttcaccctgggcaacagagaaagaccctgtctcaataaaaaagaagagaaaaactggagtgagaactctcctcctctcataatcatagtatccacgttaggaaaatgcttctgagagtaacttaaagtactgtgtgtgcatcttccttcaaaaccttgcttttttctccgtttttgtaaggtgagaaagggaaaaaccttcaccgtagaaatactgtcttgagattaagatacaaataaaacatgttaaacctccatctaaagacattgcaacttattaaaacagaaaaatgtacctttgttatgtctttccaaatatccacacccacaccctgttcagctttgttaataatacagagatcagaaatgtgaagcacaaatgctgcttctccccctcctgttcccatgtcagagatggagaagaaagcacagtgagctgttcaccagtccagcggtgacctcggagtcctttgtaacagtgtttccaataacttctgccaataaaacagaatttgagttagaacctatctgctgtccctcaactagtgtctgatagctgagaatgtaattcgtttgtgtgtctattagaaaattaggcaggcaccacagacagtagcaacataaaggaacctgcttagaagaggtttttatggtgtgattgtgtttttttttttttaatttttgtttcctgaagtagaatccatagctcaaaacaagttttaagcctgagaaaatataatttgaggtgttttttatgctcctaatgaaaagatgaatgaatgcatcattaaaccttaacagtagagcagaatttcactgttacaaaccacatgggttctcctggttgtgctgctgttctctacctgtgtgtcactgagtttgagcatcattattgtttgaatcagaggacccactggaatcaaggcttcttggaattgcgcaagaatctgagaaaacttcaatctttaccagcatttcttaatgctttccatgacttttgtgcaattatataagttcagtttagacaaaatgctgttactttttaaggcattactaataactgaaaatagttacgtcattgcccatcaagggaaaagcacttgtaactgtcatttaaaaaaaataaaactataaaacaata

SEQ ID NO: 34584 - DNA, 929 bp, Homo sapiens
gctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacagagacagggtttctcagtgttgtccaggctagtctcgaactcctga

SEQ ID NO: 34585 - DNA, 1042 bp, Homo sapiens
ggtgcggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacagaaatccgtattattggcccggcacggtggctcacgcctgtattcccatcactttgggaggccaaggctttcatagaaaccatgttcaccagtaaagcccctgtggaagaagcctttctttatgctaagtttgaatttgaatgccgggctcgt

SEQ ID NO: 34586 - DNA, 2249 bp, Homo sapiens
accagaccatcctgaatcctctggactgtttcccctgtatgtttccctggaagcttcaggcagtgcctcataagccaatggaatctgttgctaatagccacagcatatcccttgcataatatgacctctagattactgcgccttaattgcttcccagctcttctatgctttggtttagaaaaatgaagtactgacttacgggtgaagaaagtattcaaacagttgacatatttatttcagtcaagaaacagttcagagggagatacaaacaagtaacttagttacaatataatagttatgatgagaggaagtactggatgctaaacaattatatgagagacagctcaggctgggggtgtcaatgaaagcctcttggaggaagtagcctgatatgttaactttctgcatgccagtggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacaggctttcatagaaaccatgttcaccagtaaagcccctgtggaagaagcctttctttatgctaagtttgaatttgaatgccgggctcgtggcgcagacattttagcctatccacctgtggtggctggtggtaatcggtcaaacactttgcactatgtgaaaaataatcaactcatcaaggatggggaaatggtgcttctggatggaggttgtgagtcttcctgctatgtgagtgacatcacacgtacgtggccagtcaatggcaggttcaccgcacctcaggcagaactctatgaagccgttctagagatccaaagagattgtttggccctctgcttccctgggacaagcttggagaacatctacagcatgatgctgaccctgataggacagaagcttaaagacttggggatcatgaagaacattaaggaaaataatgccttcaaggctgctcgaaaatactgtcctcatcatgttggccactacctcgggatggatgtccatgacactccagacatgccccgttccctccctctgcagcctgggatggtaatcacaattgagcccggcatttatattccagaggatgacaaagatgccccagagaagtttcggggtcttggtgtacgaattgaggatgatgtagtggtgactcaggactcacctctcatcctttctgcagactgtcccaaagagatgaatgacattgaacagatatgcagccaggcttcttgaccttcactgcggcccacatgcacctcagtggaatgcagtagccctctgggcctgggatattgtggttgataactgtgccatctgcaggaaccacattatggatctttagacgggatctcgctttgttgcccaggctggtctcgaactggcttcaagtgatcctcccactttggccttccaaaatgttgcgattataggcgtgagccactgtggctggcctgaaattttctagtatccacattcataaagtaaaaagaaaataaaaaggcatagaatgtcaagctaaccaggcgtccgctacttcagaagagtgtactgtcgcatggggagtctgtaaccatgcttttcacttccactgcatctctcgctggctc

SEQ ID NO: 34587 - DNA, 5681 bp, Homo sapiens
agtttgggtcttgctggcgcgaggtagtcagaggacgtggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaaggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagaggttgtgttttcatcttaccctggattttcaacctcagagacaaccaagatatgttcacttcctcccatattcgagatccttcctgtgaagtcactgaaggccaggaaccagacgctggccccacccttcccagagctgagataccttagcctggcctacaacaagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaagggtatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtgtatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagaggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatcattggtgcgtgtgtctgcgtgtgtcaaactttaatgattatttattcagaccctggaaaaccacactataaaatagggcactggatcacaagttcgtttggttaaaaaaaaaaaaaaaaaaaagtgggggcggggggcagagaagaagtttaacttggatgatttccatgcccattccagctgtaacattctatgactgtgacccagcctttgttctcttttctcactctcctactagacatttcaatgaaaagttaggcaggaaaaaggaaaggaatcccaagttgctgccagctctgatgagagatcaggttgggggagagattaggtggttactgaattgaggtgtgggcctcccctgaccatgtcagtgatccacaacccacctcacttcttggggcttaagctaaaagcagcttctgaagagatgttaatgtcctgtaatcactagaggagaaaattcattctccttccataacattacttagtaaaggaaaagcggtggtgcaatcaaattcacaaataccaatggggtctctaaaatgtagaatgcagcttgctgggtgctggtcagttttctaaatgggaccagaaatggctttcctaagaccataaatgaactctccagccacacatacattcaaatgcattccattagacattgagctcctcaagagcagg

SEQ ID NO: 34588 - DNA, 4958 bp, Homo sapiens
agtttgggtcttgctggcgcgaggtagtcagaggacgtggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaaggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacaacaaccaagatatgttcacttcctcccatattcgagatccttcctgtgaagtcactgaaggccaggaaccagacgctggccccacccttcccagagctgagataccttagcctggcctacaacaagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaagggtatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtgtatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagaggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatc

SEQ ID NO: 34589 - DNA, 4832 bp, Homo sapiens
agtttgggtcttgctggcgcgaggtagtcagaggacgtggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaaggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacaatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaagggtatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtgtatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagaggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatc

SEQ ID NO: 34590 - DNA, 986 bp, Homo sapiens
cgagatccccggggggctcgcaggcgcgcatccctcctgactgggacgtcgcctccgcagacccctcggaggctgaagcgacgccggaggcagggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaa

SEQ ID NO: 34591 - DNA, 2505 bp, Homo sapiens
gtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaaggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaa

SEQ ID NO: 34592 - DNA, 4695 bp, Homo sapiens
ggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagaggttgtgttttcatcttaccctggattttcaacctcagagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaagggtatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtgtatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagaggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatca

SEQ ID NO: 34593 - DNA, 1747 bp, Homo sapiens
cggggcggacaggcctgggcggagcgggaggcggaggcgccgcgtaggcccgggaggccgggccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcatgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattcttaagtgatatcttctgattttttaaatgatagcacctaaatgaaactttcaaaaagtatggcaggccagacaaaa

SEQ ID NO: 34594 - DNA, 2257 bp, Homo sapiens
agtagagatggggtgttaccatatttgccaggctggtcttgagctcctgacctcgtgatgcacctgcctcggcctcccaaagtgctgggattacaggcgtgagccaccacgcctggccaggagatagaatttataagacctgatagctaatcgctgactcttaagattgtgaagtggattcctttgcagattactttggggagaaggtagggggagtacagaggaagcttctcccttcatggattcctcagctcctgtctcagcatactcaggaacttccagaggagcggcaaaggaatctggtgaattctgtttctttgtatttgctaaccaaaaggctgtctcctggcatcaccccagtgtctgtgatgttcagctgtttttccagtttctgaaatcagtgcctgtgctgtacccagccctcatccttgccctgagcagctctgaccaggactcagtcacagaaagtaagagagcattgaggagccggggcagctctgtgaactgggagtggttcagagggcttcccgagagcgggtggcatgggttgggtctagagaggcaagcaggattcggatgcatggtagtggcatgagcagaaacattaaagttgcttctgtactaattcccaggtgcttggggtagacgagttatgtgcagcctcctcgtggggaggccagagaacgggtctgtcacagggccagccctgccccgccctcctgaccctgtcccgcgcttgctccaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcatgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattctt

SEQ ID NO: 34595 - DNA, 4263 bp, Homo sapiens
gcggccgcgggagctgcggggagcgcgggggcggcccggagcgtgccggggtccccgcgcctcgctcgccggccgcgctccgaagatggtggcggcgccgtgcgcccggaggctggcccggcgctcgcactcggcgctgctcgcggcgctcacggtgctgctgctgcagacgctggtcgtgtggaatttcagcagcctcgactccggggccggggagcgccgcgggggcgcagcggtcggcggcggggagcagccgcccccggccccggccccgcgccgggagcgccgggacctgcccgccgagccggctgcagcccgaggaggaggaggaggcggcggcggaggaggaggaggacgggggccccaggcgcgggcgcggggaggcggccccggagaaccgcggggacagcagccggccagccggggggcactgcccgcccgggctctggatccacacccaagtccgctcatcaccctggagactcaggatggctacttttctcatcggccgaaagagaaagtgcgaacagacagcaacaacgagaactctgtccccaaagactttgagaatgtcgacaacagcaacttcgcacccaggactcaaaagcagaagcaccagcctgagttggcgaagaagccaccgagtagacagaaggagcttttgaaaaggaagctggaacagcaggagaaaggaaaaggacatacattccctgggaaaggccccggtgaggtgctgcctcccggggacagagccgcagccaacagcagccacgggaaggatgtgtccagaccgcctcatgccaggaaaactgggggcagctcccccgagaccaagtatgaccagccccctaagtgtgacatctcaggcaaggaggccatctctgccctgtcccgtgctaagtccaagcactgccgccaggagattggggagacttactgccgccacaagttagggctgctgatgcctgagaaggtgactcggttctgccccctcgagggtaaagccaacaagaacgtgcagtgggacgaggactccgtggagtacatgccagccaacccggtcagaatcgcctttgtcctggtggtccacggccgtgcctctcggcagttgcagcgcatgttcaaggccatctaccacaaagaccacttctactacatccacgtggacaagcgctctaattacctgcatcggcaagtgctccaggtctccaggcagtacagcaatgtccgcgtcaccccctggagaatggccaccatctggggaggagccagcctcctgtccacctacctgcagagcatgcgggacctcctggagatgaccgactggccctgggacttcttcatcaacctgagtgcggccgactaccccatcaggacaaatgaccagttggtggcgtttctctcccgataccgagatatgaatttcttgaagtcacacggccgggacaatgcaaggttcattcggaagcagggcctggatcggctcttcctggagtgcgacgctcacatgtggcgcctgggagatcggcggatcccagagggcattgccgtggatggcggttcggactggttcctgctgaaccggaggtttgtagaatatgtgaccttctccacagacgatctggtgaccaagatgaaacagttctactcctacaccctgcttcctgctgagtccttcttccatacggtcctggagaacagcccccactgcgacaccatggtggacaacaacctgcgcatcaccaactggaatcgcaagctgggctgcaagtgccagtacaagcacatcgtggactggtgcggctgctcccccaatgacttcaagccgcaggacttccaccgcttccagcagacagcccggcctaccttctttgcccgcaagtttgaagccgtggtgaatcaggaaatcattgggcagctggactattacctgtacgggaactaccctgcaggtaccccgggcctgcgctcctactgggagaatgtctacgatgagcctgacggcatccacagcctgagcgacgtgacactcaccttgtaccactcctttgcccgcctgggtcttcgacgggccgagacgtccctgcacacggatggggagaacagctgccgatactacccaatgggccacccagcatctgtgcacctctacttccttgctgaccgcttccagggctttctgatcaagcatcatgctaccaatctggctgtgagcaaactagagactctggagacctgggtgatgccgaaaaaagtcttcaagatcgcaagcccacccagtgactttgggaggcttcagttttccgaggtcggcactgactgggatgccaaggagaggctattccgcaactttgggggtcttctggggcccatggatgagccggtgggtatgcagaagtgggggaagggacctaatgtgaccgtgaccgtcatttgggtggatcccgtcaatgtcatcgcagccacctacgacatcctcattgagtccactgccgaattcacacactacaagccccctttgaacttgcccctgaggcctggggtctggacagtgaaaattctccaccactgggtgccagttgcagagaccaaattcctcgttgcgcctctgaccttctcgaacaggcagcccatcaaacctgaggaggcactgaagctgcacaatgggcccctccgcaatgcctacatggagcagagcttccagagcctaaaccccgtcctcagcctgcccatcaaccccgcccaggtggaacaggcacggaggaacgcagcctccacgggcacagcgctggagggatggctggactcgttggtgggcgggatgtggactgccatggacatctgtgccacgggccccacagcctgcccggtcatgcagacctgcagccagacggcctggagctccttcagccctgaccccaagtcggagctgggggcagtcaaacctgatggccggctcaggtagcactgggcacgaggagtgggccacagcaggatctcaacgggaaagcagccagaggggttgtggggcctgaaccccggcctcccaccctgggggaggccctctgtgaatgggtctctcctggccatagaatgatggaaagggaaggtcagcaggtcaaagcaggatcagccaacaacctgcctttggcaagctgcgggtgggatggctcagtccctgcactgtgactgtctcacctcttctggttgatcctcaagtcctacaggttccttgtcttccccttccagtgacccacccctgaccccagacgtgtgattttcagacttttctttcgagcagcagaacttcgtttacggagcacagtcataagtggaggttcagggtgctgacgaaatccaagctgctctggttgaagctgacaagtgcgaggttccctcccaaagctcagccctctgggcggtccccttgcccagggtatctcctacggtacctcttcagaacccaagggctctgcaaatgccagtttgacaagcactgcccagaccaaccatgggttcaaactccagccctgccctttggttcatttttctgcttctcttggctgggggactctggtgccagccttgaaagtcatggtcgtgggccctttcccatggaggctgcagccttaggagagctctgagcctctcagcagccctccttgggttgaactattctccttagtaactaggtaagtgggaaagccttttgatgtggcatggccaaggtccagccacaagtgcaactgccacctgtccaggggtctgggcctccttccctcaaggctgccacacaaagtagcagaaataggatgatgtttgtgagcaccagactcaagaccatgaccttctttgatccttgaaaatgggaactttgacagccatgaccatgaaactcacaaggcaacgcgatgaaactcacaaagcaatgcttggagcaaaactcctgagctagacagcacagcagcacccatcccctgccagagcccttccgttctgaggtcagacacacaaaaccttcgtcaattgcacaccggtgctgttgggagtgaccaaaccacatgaaccagacttttcccgtccaggaaatagcatttcagatttggtttttaatttcatgcccttcggccacaggctcaacgggacatgcaacataaaaatgggaaggttatttaaacaacaaaaaacagtatgatttaagtgttgagttaccagaaacccaaaaggtttccttgccacgagccccctggagtgtcatccctg

SEQ ID NO: 34596 - DNA, 3507 bp, Homo sapiens
gcggccgggttgcagggctgggcgcgcgccccgcgtcccgggcaggaagatggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggcagaggaagccacggccactggaccctggcgagggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacccccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgaggatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtatggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggtttgagcccaggggcttgccgtccagcgtgcacctgtatttctatgacgaccatttccagggctacctggtgacgcaggcggtgcagccctcagcccaggggccggcagagacgcttgagatgtggctgatgccccaagggtcgctgaagctgttggggcgcagtgaccaggccagccggctccagagtctggaggttggcactgattgggaccccaaagagcgtcttttccggaactttggggggttactggggccgctggacgagcctgtggccgtgcagcgctgggcccggggccccaacctcacagccacagtggtctggatcgacccaacctatgtggtggccacatcttatgacatcacagtagatacggagactgaggtcacgcaatacaagcccccactgagccggcccctgcggccagggccctggactgttcgactccttcagttctgggaaccgctgggtgagacccgcttccttgtgctgcccttgaccttcaaccgcaaactacctctcaggaaagatgatgccagctggctgcacgcagggccaccccacaacgagtacatggagcagagtttccagggcctgagtagcatcctgaacctgcctcagccggagctcgcggaggaggctgcccagcggcacacacagctcacaggccctgcgctcgaggcctggacagacagggaactgagcagcttctggtccgtggctggactgtgtgccataggcccctctccctgcccctccctggagccctgcagactgaccagctggagctctctgtcccccgaccccaaatcagagctggggcctgtcaaagcagacgggcgactcaggtagcagggccccagccagtacccgtggaggacccgggaaattgcaccttacagacagtggaggggtgtcccctcccacaggcaagaaccagaggcccaggctgcacacccatttcagccatcaagaacccacacagacggcagggaaggtggacacagtatgaactactgctgatgtctctgttggggatcagagggctggcgggaacgcgagaagggcaccagcagcattccacacccagctcttcctcaccttcctgtctagtttgaatttcttttttttctttttttttttttttttttaatttaaaaaggaaaatgggtggttgggagagaaactagaacagaagatgtgcaatagggctcagagcagccccaggaagtgggccatgtctgtggggagcaggggcttgctgagcccacctgctattgttctgcacgaggctgggcctgcctcactctccagggcctcatgccccattctgggcctgtggtgctcgtggctgaggctccacagggctgcaagtgccctgccaggctctaaggcccgaagaacaggtgatatcgggggcgctgcagagctgggctctagcaggacagttcttttgtagccaggggaccctagaagtggggtggggcggctccagggctttccagcataccctgcccctggatgggaaaggcagggtcagggcccactgagacccatgcagagtttccaggtgtgcactggaagtgaggtcacatgagcagcgtgggaagaagactctgtcaagactctcagaagaacctggagtaattgtgcctgaagctcagcgtgaagtctgaaatatgcaacagaagaaatatatctctatctctcta

SEQ ID NO: 34597 - DNA, 2107 bp, Homo sapiens
aggaagatggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggcagaggaagccacggccactggaccctggcgagggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacccccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgaggatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtatggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggtttgagcccaggggcttgccgtccagcgtgcacctgtatttctatgacgaccatttccagggctacctggtgacgcaggcggtgcagccctcagcccaggggccggcagagacgcttgagatgtggctgatgccccaagggtcgctgaagctgttggggcgcagtgaccaggccagccggctccagagtctggagaacaggggtctctccatgttgcccaggctggtctcaaactcctggcctcaagcagtcctcccgctccaacctcccaaagcgttgggatgacaggcatcagccactactcctggcctcaaagtaccattaaaaaaaaaaaaaaatcttaggtaacacatgc

SEQ ID NO: 34598 - DNA, 3664 bp, Homo sapiens
ccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtaaaggttgttgctgttgatgcagagttgaatgtcttctatgaggaaagtgtgcattttgacagagatcttccagaatttgggactcagggtggtgttcatgtgcacaaggatgggctgacggtcacttctccagtactaatgtgggtccaggcactggatatcatcttggagaagatgaaggcttcgggcttcgacttctctcaagtcctagccttgtccggggcgggccagcaacacggaagtatatactggaaggctggagcccagcaggcactgacaagcttatcaccagacctccggctacaccagcagctgcaggactgtttctccatcagcgactgcccggtgtggatggactccagcaccacagcccagtgccgccagctggaggctgctgtgggtggtgctcaggctctcagctgcctcacggggtcccgtgcctatgagcgttttacagggaaccaaattgcaaaaatttaccagcagaaccccgaggcctactcacatacggagagaatttctttggtcagtagctttgctgcttccctgttccttggctcttactcccctattgactacagtgatggttctggaatgaatttgttgcagatacaggataaagtctggtcccaggcttgccttggtgcctgtgcacctcatttagaggagaagcttagcccaccagtaccatcatgctcagttgtgggagccatttcttcctactacgtccagcgctacggatttcctccaggatgcaaagtggtggccttcactggggacaacccagcgtcgctggcaggcatgagactggaggaaggtgacattgcggtcagcctgggcaccagtgacaccctgtttctctggctccaagagcccatgcctgccctggaaggccacatcttctgcaacccggttgactcccagcactacatggcactcctgtgctttaaaaatggctccctcatgagagagaagatccgcaacgagtctgtatcccgttcctggagcgatttctctaaggcactgcagtccacagagatgggcaacggtggaaacctgggtttttattttgatgtaatggagatcacccctgaaattattggacgtcataggtttaacacagaaaaccacaaggttgcagcattccctggggatgtggaggttcgagcactaattgaaggacaattcatggccaagaggattcacgcagaaggcctgggctatcgagtcatgtccaagacaaagattttggccacaggaggagcatctcacaatagagaaatcttacaggtgcttgcagatgtgtttgatgccccggtgtatgttatagacactgccaactcggcctgtgtgggttctgcataccgagcttttcatggtcttgcaggtggaacagatgtgcccttttcagaggttgtgaagttagctccaaatcccagactagctgctaccccaagcccgggagcttctcaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccacaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatccctcctgttttactttatacctctctattccttgctcaaattattgcaaaagcctctatagaaagtcctctgtgatctgactcctgcagactcttccagatttttctgcccaaggcctttactgagctcaggactccagctaaatcaaaatacgcatgttctcacccagagtgacaaaatcctgcagataggtttaagacctagtggctcagagcagtagctactgggaagttaaaaggaaggggcttagaaaatgaatgggaccaaaggcatcacttctgatggagatgaagccatcttgaaagtgagtggtgtcctttggaggcatggtggatgaaaggcgcaaaggaagcaagaggttaaagataatggcccattagatacaacagcaagcccaagattccgaagaagacagacaactccccctagtaccacctagacattactttttaaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagcaatattaaaggaagagccaaaaagacccagaaataaaatgacagataaagaagattgtcaaagaaaagatgatacaggtaagattggaactcatgaagacaaaagataagacagtggcatagagttaatatttaaaattcaaatattaaaactcaaataaaccccaaagaacttttgg

SEQ ID NO: 34599 - DNA, 1737 bp, Homo sapiens
ttacccgaaaggccatggcggagcacgcccctcgccgctgctgcctgggctgggacttcagcacgcagcaggtaaaggttgttgctgttgatgcagagttgaatgtcttctatgaggaaagtgtgcattttgacagagatcttccagaatttggcaacacggaagtatatactggaaggctggagcccagcaggcactgacaagcttatcaccagacctccggctacaccagcagctgcaggactgtttctccatcagcgactgcccggtgtggatggactccagcaccacagcccagtgccgccagctggaggctgctgtgggtggtgctcaggctctcagctgcctcacggggtcccgtgcctatgagcgttttacagggaaccaaattgcaaaaatttaccagcagaaccccgaggcctactcacatacggagagaatttctttggtcagtagctttgctgcttccctgttccttggctcttactcccctattgactacagtgatggttctggaatgaatttgttgcagatacaggataaagtctggtcccaggcttgccttggtgcctgtgcacctcatttagaggagaagcttagcccaccagtaccatcatgctcagttgtgggagccatttcttcctactacgtccagcgctacggatttcctccaggatgcaaagtggtggccttcactggggacaacccagcgtcgctggcaggcatgagactggaggaaggtgacattgcggtcagcctgggcaccagtgacaccctgtttctctggctccaagagcccatgcctgccctggaaggccacatcttctgcaacccggttgactcccagcactacatggcactcctgtgctttaaaaatggctccctcatgagagagaagatccgcaacgagtctgtatcccgttcctggagcgatttctctaaggcactgcagtccacagagatgggcaacggtggaaacctgggtttttattttgatgtaatggagatcacccctgaaattattggacgtcataggtttaacacagaaaaccacaaggttgcagcattccctggggatgtggaggttcgagcactaattgaaggacaattcatggccaagaggattcacgcagaaggcctgggctatcgagtcatgtccaagacaaagattttggccacaggaggagcatctcacaatagagaaatcttacaggtgcttgcagatgtgtttgatgccccggtgtatgttatagacactgccaactcggcctgtgtgggttctgcataccgagcttttcatggtcttgcaggtggaacagatgtgcccttttcagaggttgtgaagttagctccaaatcccagactagctgctaccccaagcccgggagcttctcaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacac

SEQ ID NO: 34600 - DNA, 6506 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggctacagaacagctggtgaatgatatcctgagacaggctttggcagttggataccagacagcttctcacaacaggattcccaaagaaattacagtgagtaatattcaccaggccatttgcaacattccttttctggacttcctcacaaacaaacacatgggaatattgaatgaggaccagtgagcggagtgaggtgccctggagaagcaggctttgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgtgg

SEQ ID NO: 34601 - DNA, 6506 bp, Homo sapiens; identical to SEQ ID NO: 34600

SEQ ID NO: 34602 - DNA, 1434 bp, Homo sapiens
cgcgagcccgttgcgcctgcgcgcggtgcggccgtcgcccctcttttcgcggcgttctccacctgcgcgggcctgaatggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatccta

SEQ ID NO: 34603 - DNA, 1576 bp, Homo sapiens
cccccgtccacgtccccagcttccggaagttgcttttgtccaaacatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaactgca

SEQ ID NO: 34604 - DNA, 3147 bp, Homo sapiens
ggaagccgttctttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctcaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaattaattttaactgtgttattgaatttacttttactaaactactgttctctttgtctcttttttaactaggctctgattttgacccctaatttaagctttaagaatagaaatcagctaatatagaatcagacaaaaaggggattaaatgagcagtttgagttacattattttattgtattaaatttatttgatttatattgtcatgttctcttgccagagagaatctgtaggaaaatactgtatcttgtatactgatcattggctttttctagaaaaactgtctctgattctggacaaagctcagttatagttacgagaaagatatggtacagggaggaaaatactgccttttttttttttttaaagagattttcagactaaatagaaatgtcaaaatgatgtatcaatggttcttttttagaacaagttttcaaagcataaaaagaggttgagagaaataacatatttattgattcacataagtatgtttttcttcattaatcgtctggagaaacccacttgtcattaatttgttttgggctaggttttcaaacttaccaaattgctttaaaaaagcaatttggaaggtaatttgataggctttccaacttaaccaaattttttattgtaattcttggatagtatttttgtctttttcaattcatttgtctttttcagtatagtttttgttaaggcaaatgtcttcccttaatatccaaatattgctaataaacggtagaagatgctttggaaattaaaattatctcgctgttggttagacttaacactgttaatcttcagccaaatatcacatatggatcaaattattttcttttttgttgtttaccctatcctcaacaacatttttagtttaaattattgtagagattttttttgtggtggttattttttattttgctccaaaataataaggtgcaaagctattttatgcttaactgttgctctgtcaaaacagctatgcagtggagttgcatttgatgttctagagtttgattacatgcagagttgtatatagccaaaacttctcttatcaaactctgttatgtaggcatatttatatatacattaaagactgttgtactgtgtctcaaaaagta

SEQ ID NO: 34605 - DNA, 926 bp, Homo sapiens
gttctttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcacttcagccaaatatcacatatggatcaaattattttcttttttgttgtttaccctatcctcaacaacatttttag

SEQ ID NO: 34606 - DNA, 2255 bp, Homo sapiens
agcaacggggctggttcagggtctgaaacagagtttgggggttgtttgggattagtgaagctactgcctttgccgccagcgcagcctcagagtttggtgagtgacccaggcccgtggcacagtgttcagcttctctccacacccgtgcaaatgggcttgttgccgtctttcggcgccgcgccctggtcctttcgctcagaccctcgctctcattcaagcccttgccctgacgcggtcccctgcacctcaggcgcgaccttccagattctgcactttttcctggcaggccgcaggccttattttgcaaggaagcagtcgccttgtcagctgtaaagcccagtcctaagattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctcaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaattaa

SEQ ID NO: 34607 - DNA, 2135 bp, Homo sapiens
agcaacggggctggttcagggtctgaaacagagtttgggggttgtttgggattagtgaagctactgcctttgccgccagcgcagcctcagagtttggtgagtgacccaggcccgtggcacagtgttcagcttctctccacacccgtgcaaatgggcttgttgccgtctttcggcgccgcgccctggtcctttcgctcagaccctcgctctcattcaagcccttgccctgacgcggtcccctgcacctcaggcgcgaccttccagattctgcactttttcctggcaggccgcaggccttattttgcaaggaagcagtcgccttgtcagctgtaaagcccagtcctaagacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctcaaaaaaaaaaaaaaaaggagacacaagacttactgcaaaaatatttttccaaggatttaggaaagaaaaattgccttgtattctcaagtcaggtaactcaaagcaaaaaagtgatccaaatgtagagtatgagtttgcactccaaaaatttgacattactgtaaattatctcatggaatttttgctaaaattcagagatacgggaagttcacaatctaccttattgtagacatgaaatgcgaacacttacttacatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaattaa

SEQ ID NO: 34608 - DNA, 684 bp, Homo sapiens
cacgtagcaacggggctggttcagggtctgaaacagagtttgggggttgtttgggattagtgaagctactgcctttgccgccagcgcagcctcagagtttgacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcatta

SEQ ID NO: 34609 - DNA, 653 bp, Homo sapiens
ctcccgcccaccggtgcccaacctgctaacacgcctgcgcgagcgggcgtgccccggaagccgttctttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaatatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcag

SEQ ID NO: 34610 - DNA, 557 bp, Homo sapiens
gttctttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcacaatggttttttgccttgcttttggagccacattgctactggtaa

SEQ ID NO: 34611 - DNA, 1124 bp, Homo sapiens
gaagagccaatggcaggcgcgggggatgacgccacggacatggtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtgggaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 34612 - DNA, 4329 bp, Homo sapiens
ctccaaggctgttaacggcgtctgggccgggctacggctccaaaacaaagggcaggcggcccgcggggcggcggcgggaggatgcctcgcgccctgcctaggcgttaacggcctcagcgcgtcccgggccgcgccgggaacgcctgagagccgagcccgcgctgaccggggcccgggccggatgggcgctgcgggccggggcgcggaccgcggagcggccgttacgtttttctctcgtcccagctgtgtggacagtgccacacgccctcctggacaacgacggctcttgcgtgcattttccagtgttgcttttgtcagagaggccagcagagccacggttcttccagaaccagccctgagctgagtgaggagtgcccaggagagatggtgaaaatgacaaagtccaaaactttccaagcgtatctgccgaactgtcaccgaacgtacagctgtatccactgcagagcacacctggccaatcatgacgagctcatctccaagtcctttcaggggagccagggacgcgcctacctcttcaattccgtggtgaacgtgggctgcggccctgcagaggagagggtccttctcaccgggctgcatgcggttgccgacatctactgcgagaactgcaagaccacgctcgggtggaaatacgagcatgcctttgagagcagtcagaaatataaggaaggaaaattcatcattgagcttgctcatatgatcaaagacaatggctgggagtaatgtgcgaactttcccttctcctttgaatgctgttttgtgaaagaaactgtgaatgtaatggaaacgtaggagcatctggtgacagcctttcttgccctctgacctcaaaggctagctgcgcatagctcttgacactctcggccatctctgtgggtaaggtgtccctcggatctgtcctcttcgtgtacacagttgtttctgaaaattttcaatgagctttttctaacttctcaagttctagagaaagaattaaccaactgatgacttacctgcctagttaatatcttcctttcacctttgtcttcaatatagttgggctctgcttttttaaggttcagttgaaaaccaaactggggccgggtgcggtggctcacgcctgtaatcccagcactttgggaggccaagatgggtggatcacctgaggtcaggagttctagatcagcctggccaacatggtgaaaccccatctctactaaaaatacgaaaattagccgggcatggtggcgagtgcctgtaatcttagctactcaggaggctaaggcaggagaatcacttgaacctgggacacggaggttgcagtgagctaagatcatgccatcgcactccagcctgggggacaaaagtgagacatcgtctcaaaaaaaaaaaaaaaagctgggtatggtggcgcatgcctttaatcccagctactcgggaggctgaggcacgagaatcacttgaacccaggaggcggaggttgcagtgagccaagatcgcgccactgcactccagcctggcaatagggcgagactccgtctcaatttaaaacaagagagaaccagactgagtctctgaagaccacagggacagggtctctttagatagcaagtctcaccattcccttttttagagaaaaggtattgtagcccaccctccaccccgctgtttttcttaaatttgcagaacttcaaattggctattcctcttgcaaatgaacccttaaagtacagtgttatttaagaatcttccagaggcagtcaacagacttatacactaagggcatttttggtttttagcttgttcaaaaacagaggccagcacagatgacattttagatacactctaaattgagaatggtgtctagtggaacatgtttatttaagccagtagattccttatctagaaagcaggtgagctagcccttagagaaggctgtcccggggcccgcagaggtgcccttactgaggtgacagcctcacagggtctggtaccaggggttgtgccctcagcagtgacagcagcttaggtgtcaggcagttgctgagtggctggtccatgtctatagagtaacacactggaccgaggaaaagtcagatttcattttctaccctggatgtacttgaagaaaaagaattatttttgcatatgaaagaggccagaacccacaggaaaaacttcaaaacttgacatttgccagaatgtttaaaatttgttcagaaaaggttaaagcaacaagtttagcctttgtgcatgaagacgcctggcctgctagacgcgttgcccgtccctgcgtggtgctgtcccatgtcacttgaactgatagaggggcctgtgcaatctcctaaggcctgtgtttctgccatatattttattataaattacaatccactcatccacctgccctccaccaggagtgggcaccccataagggtttaggccactttgcagaggatggaggtcaaaaaccactcccagataagtttggttttcaacatttagtaacttgtctcagggcagagggcaggcagggggaccgaggggcagcagataggagagcactgagcccggatagttctcagcctggcaagtggctctgaagctgccttcagacaaggctagtctaggggcaagagtgcgagctggctgacaataagaacgtggccacctgcccagcttcacacctcccccgacttcagcccttcctaaacccagacctgcggtccaggcaggcactgggctgtgcccactcgagctcactgcccacacacagcatgcctttgggtgccatctctttgcccaagcctggaagccttggcaggtgggaaatgccgctgccctggtgggcatggcactgagatgcatccactcagcaggagtgacagaggcagaagttcctttaaagcacatcttccacttaggaaaggaaggaaatctttgtactgtcttggaagcctccacatccggctatggccctgcaagctgctttatccctgcgctagtctcccccgagggtttaggctggcccagcacatcctgtcctcctgagctcgcgtgcagccacccagagcgcaggggtcactgcacgctgcagggctcttgctgccatggtctcaagcctgaagaggctccgcccacaagctggcccatgaagttagcaatgcctgtggcttcagtcaattgtcttgagactgtgaagaggctgaaagacaccttcccgggtggaagaaggagttcactgaaaacttatcttaaactgacccttccctttgagtgagtcttcattcctctcccatgtgggaacccagcctccgatgccccggggactaggggaaacagttggaggttcgtgccgtccccagcctgccacgggtgcgaggacagccaagtcctgagtgactcaagatgcttcacttacatggaagaaacttctaaaactctaccgagtggtttttgtatatactaaagttctatttagagcttttctgttttgggcaagttcgctgctccttctatttgggcactttggtttttgtactgtcttttgtgacggcattgattgaacattttttactagtagtcttatgacttttgtatttttttttttttttgtaatttataccaacaacacttttatcactttttttttgttgggcttctgcaaaatacaagctcatttttaaaccaaatgaacagaccatgagctggcttcaggggaagtgctattcacaggaccatatccaccaccctcttaaattcctaaacaatatcatctaggacttctatttaagttatttaaaataaatcttccttgagagccttgggaggtgatgtcagggttataaatggcacagtgcatttgctgtaggaatgtggtttggcattgttttatacacacagtattttttataccttaatgcttattcttgatggcatctgtcagatattagaattgaaaataagaatcttcccaaaatcctttaatttacctgatgccctcatcaggtcgttaaaaattcaaatggttttaatagctaaaaaactacaaattaagctctaaaacaaacaaactacagaaatgtaaaccttcatttgccaaaggtccttggtggcctgtcccctgccctgggagcagatggccctgaagcccttccctcactgtgcaggccaccgggtgaggctggacggtcacccatggtggcttcactgcaaggagcaggactgccgagctcaagcacggggccttcagcttcccctgtcctctggccacaccgccagcccttggtccttatctgtgtgaggtttacaaataaagcttctgatgtcaaa

SEQ ID NO: 34613 - DNA, 5232 bp, Homo sapiens
gccgcggcggtggcggagactgtggctttaagagcgtgccgggagcccgagccccagccgggccgcgcttcgccgctgcgcaccccagcggagccaagccccacgctggccggacagggccgcctgtcgccgggctgctgagaactagccctagacctctgcgtgagggttcttctgccgaagacatcaccagtgtgtggagcctgccacacccacccgctgccaaaccacggcctttacctgtgtcttccggtgtttcccgtgcgacccatcctgtgggagtgcctcgtgggctgccccagagttcaccccacactcagcagcaccaatggtgaagatgacaagatcgaagactttccaggcatatctgccctcctgccaccggacctacagctgcattcactgcagagctcacttggccaatcatgatgaactaatttccaagtcattccaaggaagtcaaggacgagcatacctctttaactcagtagttaatgtgggctgtgggcctgcagaagagcgagtgttgctaacaggactgcatgcagtcgcagacatttactgtgaaaactgcaaaaccactctgggctggaaatacgaacatgcttttgaaagcagccagaaatataaagaaggcaaatacatcattgaactagcacacatgatcaaggacaatggctgggactgattggacagcatctacccaacccagtgtccacgtgaacgccattcaaccgaacattcttcccaagcgtgagagagtgactgacacttggttccatccatttaggggccttgccatccggggcatcctcccaccctgacgccatctttctggtgaccggcctctaaatcgctgtctctctgtctctttgctttgtatctgtttgtgagttgatcctggcttctctctctgttctagttttggctgaaaacaaaacaacaaaaggaacagatccttgaccgcatggcggcagcccaccttggtaagggccccagggcccatgcgagagctgcctgatggcctcttgtcaggagagcagtggcacgggggcgtgaggaagagggaaaggggaaactctaagggtcctggcgcggggaaggggtggaagggtggaggtaggaacaaaattgcgccgctcctggagacctgataacttaggcttgaaataattgacttgtctaaaaggacaaagagaaaaaaaaaatacctcatgactgcattctctctgactagaagcttctgttcctgacaccaaatgtgccaggttagcaaatgagcacaagatgtggccctgattctagttggtggggcaagggcctggttctcctgggctgagtgggggagtgtcctggcagcagcgagtgacctgggcagtggccaggtgggtgcgatgactctgatgcctcactcagtctctgggcaatcatcatctttgcctctagccaccgtagataaggtgtgaagggactgctgtttgcaatgggcttaccatccaaatatcccaaaggctttgaccagcaaccaagtaaaatcagtaattgaggagagcagggcacaaaggggctgcagtttgggagctcctgaagaaatggctcagatattgagtcagagaaataaaaagtaggatcagttagcaattctaactgcccttccttctgacccctcataagaggagtgtggtgagggaggggactgggtaggggtcatcccaggaggaggggtttacattggaaccagttcaggttcggtgcatctttcctcttcggttttacagtggcttccgtgggatcgtcaatttcttgttcttagagtttcgggtgtttttctccagtcttgttactgtagactgtagaaagcacgggccccaggctctgagcttagtaataacctggctggtagattcctcatgcccctaattgtcccacttaggcctgaatgtcttgcatggagagaaatctcctgtcagtgtggtccagcagcagggaggagttctgcccaaattccgatatcaccccttcccccatccaagcatccttcgattagggaagtggagagcacatccctgtaaggcccataagagaaagaggagtttgttacatttaatcaacactgtgaagtctgttctacagcaattcagccattacacagtatatgactgaaactcatttaactgggttaatttcatttcttagactgaatatattattgttaagatacgtgtgcgtgttaggtaattctcagcatctcctccaagtaggccgaccttctcggaaaattcaccctaaaagtctcacaaaagaatgagttcatggggagattctgtaaagtgatgaactgagatgaaagcagccaacagcccaggagcttttcagaatagcgtctgcagcagaaccagtttccattcagagcgcgtccttggtggaaatgcttttttgtgtgtctccacgcgctgatggtggaatgggagccccaagacgtgtgggcttagaaatcaacttttgttccccaaggcttcttgtccagatctttccagtgctttcatagccctgggagatcaagttgttctccccactttactgcaaggtagactgaagttcagaagaaatactgaatttctgctcccagaagaatagtttctctggctcacaggcccaagttctcaatgaaatcgttttttaactttcacattcctaagctggcttcccggcacagaagccatggatttcccctctctcccttccccctcctcaaggaaatagtcttcctttatggattttcattggactctttcctcagcgattgtcctggctgtttattgatagtccttcccataagaaaatggggttaaacatggggtaggtattttgtctttcaaactacaaatggaatgtggtgacataaactagacatggggtgccctcaagtttccaaggggaccaatgtgccactgttcttccttggggatgaggcctttgactgttggatggatcagagcaggctccagtcagaccctggttctgaatgttttttttttcggtgactatccagtgagccttcagtgggtgcaaggcgccatacttgctgtgagagagctgagtagagtgttggtttttccataactacagggggaaaaaaagtcattaggctttccctttgtgtcagtgaaaccaaaagtgcttcttacaacgttcgctctgttcatgggttgtctatctaacattgagcagcattggagaggccacagctgagctatggagatgctaaattaactcatggcctcagtcagttcattctttaatttcctcaccaaattattgacttagagcataaccaaagacctcattcattcaccccaggtgggttggggtaattggagtttgttggtgaagtttgggggcggggtgttgggagtagagacagggtaaggggacgtgagaaaggaaaaggcatgaagttctatacctcagccagcagctgccttcgtttggaactgaagtccagccagcagactctctagctccatctcccctgtgccaccctaggtcatatgaccttggccaccttggagtagacccagacccctcgggacccgggacattagtctcaggctgctgatggattgatttgacatgaaccaaacacagccaaactcgatacccacaagctgtcagctgaacctgactgagtgttcttcctgagttcacgaggataggctagagtgcatttttactggtggatcagtgtgtgcgaaagagatgaccctttataaagagattttcaagtggatatatataaaagaaacagttgcttgtaaaatatacttttgtaaataatatttaattttttaaataatatatttggtgctgttttctcagatcccctgagagcactttttattttccttttaaattctatggtttcctttgcatttcttgaagtatattttaagggaaacagtgatcaccaatacatgttttcagttttttttttttttaaggtctctatcactttaatctggatcaaggctttgaagcaatgcctctctgcattttttccccagtggaacagactctgcagtacattaatcaggttgagaattgaaatattttcttgcatcagtattggctagaaaagaaaataaataaaaccaagttaatttagtagtaacaacttacagtgattcttcctgttggaagaatttccaacaaatcagaatcacgtttttagttgtgcgtgtgcgcgcacacgtgtgtaaaaagcactttcgattgtgcctcctgttttctcgagtggggacactttaactacagtttacacctcgggcgcataaagtttttcttctctttctctctggttgtttctgtttctgagtggaccaacagcagaacccacgaggatttgttttgagtatggagctgttgcgggtttgctcctttttcttgctttgcgtgctcagtttttacagactgtaaaggagatgtgttgtttgtgaagatggagcagagtcaaatctgtgcttctaactgagatgagagtgtattaatcacgtatcgcagggctccagctgttttagaagccacatcatgttaaacattaactggtttggattaaaagaacattaatattataatacacatatcttagtggtaaacagctttttttttttaaggtcagattgcctcaggtttagaaagaggctgagaaatcaaatcttgaacacaatcaacttacatattttaaaggaatctgcctcaaatgagaaaatatgctagttatctagatagaggaaagagatatttacttttttaaaaattaaaatagttatgaaatctggcagaaaaggtaaagcctagaagaaactatgaaagctattctcatgttaccaaattctatctgcgcatatgtttttgtataacatttcggtgacagtgggagtcggttccctttcccaacctgcagagactatcttccaatacagaatctgtctatttatgcttgtgtttacaaactgtatttgttgggtttgggtttttgttttctttggtggcatttttcaggtcactttgcttctataacaaaggtaattgttttcaaataatttgtcttcaccttttcctgtatttgtacatagtgattcagtattagagaaaagtgcattgtttctgtcatatttccaatctgtgttggtgctcatttgagaaaataaaagttttcaaatattaactctt

SEQ ID NO: 34614 - DNA, 940 bp, Homo sapiens
ggtgtaaacaagtccaggcgcctgcgaacccgggcccgggggggacggcgcccgccaggagcgccccccactcccaggccagcccaccccggcggaccgggccccgcgcgcccaggcgaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtggaga

SEQ ID NO: 34615 - DNA, 1588 bp, Homo sapiens
ggcgcctgcgaacccgggcccgggggggacggcgcccgccaggagcgccccccactcccaggccagcccaccccggcggaccgggccccgcgcgcccaggcgaggtgaggcccgcgccgtcagggctgcgtgtcgccccgcgcccctgcccagcccgcgaggactgccccctcccccggcgcccgcccccacccccgcgccccaggtgagccccggagtccaggtaaggctccgcgttgcaggtaagagcccctgagcgtagaggaggccttggcgcccgcaggtgagagcccctcccctcctaggtgaccctcaaccttcacggcgaggcctcctacctcctccaggtgggggaccctctccccgatgaaccccctaaaccaccagtgaaccccactgctctccagatgaggtcgcaaggaccaaccagtgcctacccgcccatgctcccccgaaactgggaactgacagcccagcccctccaaagccccttcctccagcttcagctgccaggtcagcaagggtgaggccggaagcaggcgggtgactcaccctgggcacctccgagcctcagtttccccatggatgcaacctgaggcctcctcactgagtcaaaaccgagacgcctctggtccccggagaggctgctggctctggggaaaggagagagcagcccagtgtgacagagcgagtccccacggctctgggagtgcctcgcatgtgtgtggcccaggtcctgacagcccacctactccctccccggcaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtggagaca

SEQ ID NO: 34616 - DNA, 1721 bp, Homo sapiens
agtgttatgatgcagttccacaacacacagccacattcacccacagaccgaggtacagaacgagagacaacctctgcccccccagcagctggccagctttgcagccccagtcttgagcccccaactaccctccccccacccacccccatccccttcccaattgaaggagcggaaagagaagagagaagagtgagcagagagattgagagattgagagagagagagagagatagacggagatctctggagcagacctcaaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggggtgttaaggctcaggagtgggcagcagtcagggagagacagaactgggggaaagggatggttgtgggtctttctgttcccaagatcctgaacatggaagcgatggcagggcatagactcaggcagagaggattgtgggaggaatccgtttttgctccacctctttttgagtgaacagaggacaaaccttgggtcacagggcaagtagatcatggaccacagaacagcagatgagaaaagacttgggttggagtgaaattctggtctcagacaccaggagaccagagtctctgaggatgaagtttcctacccctatttgtagggaaaaggacttgagtgcagggaaaactcaaatcccaggccctgggaaatagtaaaataatcaaagggttttccatttcactccacttgttagtttatcttggcactgaagaggcactttcgagtatctaacttttgccattgggtggggtggggacagctgctcgcggaacagcccctagtcggctgcttccagagtaagcagtctttatgggctttctctgaggcccagtcactgctcctgggacccagtcccctggaggggaggtggaaaatcagtgctacggggccagtctttcccgtggctgccaccagcgaatgaaacttttgtatgatacataaagtgcttgagtctatttttaataaaaagggaaaaagcaacttg

SEQ ID NO: 34617 - DNA, 4000 bp, Homo sapiens
agtgttatgatgcagttccacaacacacagccacattcacccacagaccgaggagcggaaagagaagagagaagagtgagcagagagattgagagattgagagagagagagagagatagacggagatctctggagcagacctcaaggtgagggggcagcccttctccaaatgaatttttttctctttgcaaatttcctcctcctgctgcgtgttgctttctcccctttgcaaaagcattattcatccaccctttgtcctcccttccccctccccgctgcctccgctcctctctctcggttcctccatccctctccaagctctgacgattcccgcacttatttcccggcaactttggctgcagcatcaggcatcactgtttattgttttgctgctggtgcagacccccaaagcctgccctgggagctggcggtgctgctaattatttggaccataccatactgagaataccagcctggggggtgccaaaacctcagagcagatgagaaaatccattgtgagcaggtgtccccccccttttcttttcccccctgagaagcacgagattcgcacctggttcctccagcctccgcctcggcgcctctgctgtcagctgtcagttgcccccgccagccctccctctcccctttctcctacggtccagccccgtctcacttcaggggaacatctctccccagcactcggcttgcctttgttttttctccagtcatttgcccaacttgcttctccctgtgatccgagatgggtgaaaaaatgacccctactcccctttgtgattctctggccttctgtgcagcctttccttggcttgactgggaattaggggagagggagggaggcgtgacggccggaggctggagaaggagctcaggattggggacccaagctgccccattctccatgccccttgaagaaggtgtttcaaggtggtgcatgtcagaggggaactcgctggcaaagttgaaggcaaacctgtgaagcagagactgaaaggtggtctcttggcaaggagggcccgtttcctgcagccggagcccaatgtcaccctgaactcagcccaaggtgtcttcctgggacccagcccggaggagaggacctgaaactgaagatagtctctatggaggttttgcggagagactgcctggcggccttcagagagagtggaacagctgggtgcctgtggccactgcggaggacaggacgaggagagcctgtatgccctggctaaccagagccaacactgcctcttctctgcttagtgctctagcattgccagagtgcccagctggcatctctgaaccagacttaggctaaccacccacagtgggctgggaagccctatgaaggagaaagcagcagctcacctgcttatcggagccaacaggggccacctcccttcttatcctctgcctccagcaccttcagccactcggaggctggcgcgtgggcagaaggcaatcttcctctattcctaatcagaacccagcaattacttcatcttcagtcacccacagagtcactgctgtttgtccctgcccctgggagaaggtagaaagaaacattttctgccttgtgccccaaagcacagctgttaaaaataagagtcccccttctgctgttcgttgtggccgttgctctcaccctaccacacagccctgcccagcccaggaatcaggctcctctgacatgctacccatttcccattggctccagctgtcagattgcctgaagaaaatgtattttctgcctaagtctttaaccaagggctaaggcaacagttagtaaagactaggagagagaaagaccaaggggcccacaggctgggaagacaggcaggtgcttattctgggccagaatgagtgaaccaaggtgcgagaatgggcggccacacgtgagggctttggtactgttggaaacatctataaagttctagtgaagagtcccagagcacaggaccctgacctcaggagagaaccgaatcagggtttgtatacctgcctgcatgctctccctcccctcaccttacacctcctgcccccctccccaaaatgtataaaggaccaattgtattgcaaacaaagaccatgtaaaagaaagaccttcaggcatccccaactcttaaaaggctctgatcccctgagacacagtgcctgtgcgatgcagagcctcacgaagaactgaaaaccaaggagagggcacttgcagatgacgttgctcccatggcagcgtctgtgcccgtgggcttctctctgtggaaaatggtggaggctgcttctgccccaggagggagaaacaccgactccctggctttggcgccagaagcctggatcggctgccaggtttgccagagcagaatggggatccaggggacagggcgacaatgcaactggatgctgtgggggggtcgatggtgatggggaaagtagaggtatgggtgagctgattcccttttcctccattccctcaggaggggtcctcctgaggtcgcagctcccctgatgtcctttcccctcttcccaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggggtgttaaggctcaggagtgggcagcagtcagggagagacagaactgggggaaagggatggttgtgggtctttctgttcccaagatcctgaacatggaagcgatggcagggcatagactcaggcagagaggattgtgggaggaatccgtttttgctccacctctttttgagtgaacagaggacaaaccttgggtcacagggcaagtagatcatggaccacagaacagcagatgagaaaagacttgggttggagtgaaattctggtctcagacaccaggagaccagagtctctgaggatgaagtttcctacccctatttgtagggaaaaggacttgagtgcagggaaaactcaaatcccaggccctgggaaatagtaaaataatcaaagggttttccatttcactccacttgttagtttatcttggcactgaagaggcactttcgagtatctaacttttgccattgggtggggtggggacagctgctcgcggaacagcccctagtcggctgcttccagagtaagcagtctttatgggctttctctgaggcccagtcactgctcctgggacccagtcccctggaggggaggtggaaaatcagtgctacggggccagtctttcccgtggctgccaccagcgaatgaaacttttgtatgatacataaagtgcttgagtctatttttaataaaaagggaaaaagcaacttg

SEQ ID NO: 34618 - DNA, 889 bp, Homo sapiens
ccgactccctggctttggcgccagaagcctggatcggctgccaggtttgccagagcagaatggggatccaggggacagggcgacaatgcaactggatgctgtgggggggtcgatggtgatggggaaagtagaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggg

SEQ ID NO: 34619 - DNA, 561 bp, Homo sapiens
ttcacccacagaccgaggtacagaacgagagacaacctctgcccccccagcagctggccagctttgcagccccagtcttgagcccccaactaccctccccccacccacccccatccccttcccaattgaaggagcggaaagagaagagagaagagtgagcagagagattgagagattgagagagagagagagagatagacggagatctctggagcagacctcaagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccact

SEQ ID NO: 34620 - DNA, 2510 bp, Homo sapiens
ctaatcagaacccagcaattacttcatcttcagtcacccacagagtcactgctgtttgtccctgcccctgggagaaggtagaaagaaacattttctgccttgtgccccaaagcacagctgttaaaaataagagtcccccttctgctgttcgttgtggccgttgctctcaccctaccacacagccctgcccagcccaggaatcaggctcctctgacatgctacccatttcccattggctccagctgtcagattgcctgaagaaaatgtattttctgcctaagtctttaaccaagggctaaggcaacagttagtaaagactaggagagagaaagaccaaggggcccacaggctgggaagacaggcaggtgcttattctgggccagaatgagtgaaccaaggtgcgagaatgggcggccacacgtgagggctttggtactgttggaaacatctataaagttctagtgaagagtcccagagcacaggaccctgacctcaggagagaaccgaatcagggtttgtatacctgcctgcatgctctccctcccctcaccttacacctcctgcccccctccccaaaatgtataaaggaccaattgtattgcaaacaaagaccatgtaaaagaaagaccttcaggcatccccaactcttaaaaggctctgatcccctgagacacagtgcctgtgcgatgcagagcctcacgaagaactgaaaaccaaggagagggcacttgcagatgacgttgctcccatggcagcgtctgtgcccgtgggcttctctctgtggaaaatggtggaggctgcttctgccccaggagggagaaacaccgactccctggctttggcgccagaagcctggatcggctgccaggtttgccagagcagaatggggatccaggggacagggcgacaatgcaactggatgctgtgggggggtcgatggtgatggggaaagtagaggtatgggtgagctgattcccttttcctccattccctcaggaggggtcctcctgaggtcgcagctcccctgatgtcctttcccctcttcccaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggggtgttaaggctcaggagtgggcagcagtcagggagagacagaactgggggaaagggatggttgtgggtctttctgttcccaagatcctgaacatggaagcgatggcagggcatagactcaggcagagaggattgtgggaggaatccgtttttgctccacctctttttgagtgaacagaggacaaaccttgggtcacagggcaagtagatcatggaccacagaacagcagatgagaaaagacttgggttggagtgaaattctggtctcagacaccaggagaccagagtctctgaggatgaagtttcctacccctatttgtagggaaaaggacttgagtgcagggaaaactcaaatcccaggccctgggaaatagtaaaataatcaaagggttttccatttcactccacttgttagtttatcttggcactgaagaggcactttcgagtatctaacttttgccattgggtggggtggggacagctgctcgcggaacagcccctagtcggctgcttccagagtaagcagtctttatgggctttctctgaggcccagtcactgctcctgggacccagtcccctggaggggaggtggaaaatcagtgctacggggccagtctttcccgtggctgccaccagcgaatgaaacttttgtatgatacataaagtgcttgagtctatttttaataaaaagggaaaaagcaacttg

SEQ ID NO: 34621 - DNA, 2182 bp, Homo sapiens
gccagggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagtgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 34622 - DNA, 2499 bp, Homo sapiens
cagggagaggcggggccaaggccagggcctgactaaacctggagactcgggtggccgaggggcttcataccagctgaagagcgacaagccgctggcagccgcggatctcaccgccgctcaggagatctgttggtaatctgaggatttttattctacgtcgtcttgacagatggaaaacctgaagtaacttcgggctaaccttgtgtttttggaaaattagtagacttggtggtgaagaaactgggaggagtaggatattagctaactttgcatagccacatatagagcgtcgcagctgcattccaccaaagaggaaccaaaaggcctgtggtgttcccagggtacatattcatgccagaagtgaagtgctttggtgaattcgtttcctgaaagtttatcgcatacttgtactgggttaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagtgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 34623 - DNA, 2560 bp, Homo sapiens
cagggagaggcggggccaaggccagggcctgactaaacctggagactcgggtggccgaggggcttcataccagctgaagagcgacaagccgctggcagccgcggatctcaccgccgctcaggagatctgttggtaatctgaggatttttattctacgtcgtcttgacagatggaaaacctgaagtaacttcgggctaaccttgtgtttttggaaaattagtagacttggtggtgaagaaactgggaggagtaggatattagctaactttgcatagccacatatagagcgtcgcagctgcattccaccaaagaggaaccaaaaggcctgtggtgttcccagggtacatattcatgccagaagtgaagtgctttggtgaattcgtttcctgaaagtttatcgcatacttgtactgggttagccttatgccagcctggaccatcttggaggcagtgtaggatcatggaagaactttgaattaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagtgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 34624 - DNA, 2197 bp, Homo sapiens
ataccagctgaagagcgacaagccgctggcagccgcggatctcaccgccgctcaggagatctgttggtaatctgaggatttttattctacgtcgtcttgacagatggaaaacctgaagtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagtgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgca

SEQ ID NO: 34625 - DNA, 1735 bp, Homo sapiens
tcgcatagtcgggggcgcgcccggtctccgccccgaatccaagtcggaacttgaccgagttgtttgggccgcgatgaccgcacggcgtgaaccgtcctgagcagggcccacgcccggcccaagcggcccagccaccgggctggggcggtgtctccctttgccccctcccccccatgaacgtccgcctcccccgccctcctgcccagaggacccgggactgacagcgcagggtgacggttgggcagcccgccgggtgtcgggaccaagagagccccccggccacccgctcagctgtttcctgctcgtgtttgttgtgccgagggaggccccgccgccaccgccgccgccgcgctctgccgccccggtccctcccgattggccggctggcgtcacgtggcctccatcagctgggccggcgggggcgctcgcgggccccactgcggctgccgggtgagcccacccgggggtcgcccgggccggcccagctccgccagcttcgggctgcggccttccctccgcttgcagtcgggagggtgggcgtgcccttgcaacccctttcctgtaccttctctgcagccttatgccagcctggaccatcttggaggcagtgtaggatcatggaagaactttgaattaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagtgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttgga

SEQ ID NO: 34626 - DNA, 3994 bp, Homo sapiens
aggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagtgtatgttcagtgacttcctgacgaagcttaacattgtttcaattggcaaaggaaaaatattcgaagggtacagatccatgttcatggagccagcaaaaaggatgaagaagagcttggacacaaccgataactggcacatccgtccagaacccttctccctctcaatccctccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatacaagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 34627 - DNA, 2517 bp, Homo sapiens
ggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagtgtatgttcagtgacttcctgacgaagcttaacattgtttcaattggcaaaggaaaaatattcgaagggtacagatccatgttcatggagccagcaaaaaggatgaagaagagcttggacacaaccgataactggcacatccgtccagaacccttctccctctcaatccctccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaac

SEQ ID NO: 34628 - DNA, 2469 bp, Homo sapiens
gtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatgttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatacaagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaac

SEQ ID NO: 34629 - DNA, 3856 bp, Homo sapiens
ggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatacaagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 34630 - DNA, 986 bp, Homo sapiens
gtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccagtactggctaacaaactgaagcagctgcttgttattgggcatcagttatgtaccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccattttt

SEQ ID NO: 34631 - DNA, 775 bp, Homo sapiens
tgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatgttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggg

SEQ ID NO: 34632 - DNA, 2459 bp, Homo sapiens
ggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagtgtatgttcagtgacttcctgacgaagcttaacattgtttcaattggcaaaggaaaaatattcgaagggtacagatccatgttcatggagccagcaaaaaggatgaagaagagcttggacacaaccgataactggcacatccgtccagaacccttctccctctcaatccctccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactatgccaaagagattcaaattgttcttgaggggaaaaagttggaagtga

SEQ ID NO: 34633 - DNA, 6265 bp, Homo sapiens
ccgcaccgaagcgtcgcgataactgcaaccacccgcaacttctcgcgatgtttggccccgctaaaggtcgccattttggagtccacccggcgcctggtttccccggcggcgtctcccaacaggctgccgggaccaaagctggccccgcgggtgcctggcctgtgggcagccggaccgacacgatgtggcggctccgctgcaaggccaaggacggcacccatgttttgcaggggctgtccagccggacccgggtgcgggaactccagggccaaattgccgccatcaccgggatcgcccccggcggtcagcgaatcctcgtcggataccctcccgagtgcctggatctcagcaatggggataccattctggaagacttgcccatccaatctggtgacatgctgatcattgaagaagaccaaaccaggcccagaagttcacctgcatttactaaacgtggtgcttctagttacgtcagggaaactttgcctgtgcttaccagaaccgtggtcccagcagacaactcttgcctctttactagtgtgtactatgtcgtcgaaggaggagtcttgaatccagcttgtgcccctgagatgagacgcctcatagcacaaattgtagcaagcgatccagacttctatagtgaggcaatactgggaaaaacaaatcaagagtactgtgactggatcaaaagggatgacacttggggaggagcaatagagatatcgattttgtccaagttttaccaatgtgaaatatgtgtagtggatacacagacagtaagaattgatcgttttggggaagatgcaggatataccaaaagggttctgcttatttatgatggcatccactatgatccacttcagcgtaacttccctgatccagatacacctcctctgaccattttctcctctaatgatgatattgttcttgtacaagcactggaattagcagatgaagctagaagaaggagacagtttactgatgtcaaccgcttcaccctgagatgcatggtatgtcagaaaggattaactggacaagcagaagcaagggaacatgccaaggagacaggccataccaactttggagaagtgtgacctatgcatgaatgagggttgaagcctactacctcacacatccagaaggctctgggttttccaataagctatggtaaccctaaagaacaaaggatacaatgcttgaaccatccttttaacttaaaaccactaagacactgaaattccttgttaagattaaaattagtgtgcaagtttacagatgtgtgtctacagtggtaaactgtacatacatgcctctttctgctggagtgacagaataggtgatccttgccacctactgacactgacctgaaggttgagattgagtattataaactagcacccagcagctttaacttgtagaagaaagcatcacattttgggtaatgtggaaggcctcctgtgagtccactgggcatacgattgagattgagtattataaactagcacccagcagctttaacttgtagaagaaagcatcacattttgggtaatgtggaaggcctcctgtgagtccactggacatttaccacagtgtctccagtaactgagtctttttaaaaactctgaatgagttaagtttctaaattatgaattgattcatcaaatgaagatactcagaattgtccaaactgattttatattgcaatttggtagacattataaatgtgtgcttaaccactgataagtacatcacaagcaatttttacagggatgagtctcatccttgagaatgttatcacaaaacaggaactgattgtgccctgtttaagatctctagcatataaaacgtagaatgtatgagggaataggtgcctgagcagcttcctgaagctttaaaagaccgttggcctcgtgttttaatgcaattcatgtattggtctttgtcacattggataacattttaaagttaagcagggtacttttttaattgaaattccttgaaattcgagtcctcagttttttcttcatttgcgtaaagtttatcggggggaatttaattttctcagctttttgttaagagcacttcctccaaaaaatttttttcaagtaataatgctctgctttgggttggtttttgtaagattttttgcacacctaaagagtgtttgcttttgtgctagccttatccctccactaaagttattttaaataatttcacatttctgcaaattagcactttgcttatctgcaatcttttactttgatttttgaagttttaaagcaattggagtaatactgttgaatgaactagtttcacttccaaaatagaaaaaattgtaaatccttgccttatgcagctttctcagaattctgcttcttcctagtactagatgtgtagccatttgcttagtggactaatccgcaaggcacaccctctaaaacttagcttcactacaagatcttccagataaaagttttctacctcttttcttaattattctgatcagggatgctaaattataatttgttatgtattatctcacataatgtgaagaggcttaatgtgaagttttgttattttggtctcttttttattaagtatctcacttagaaattcagtggtatactttaaagcacttggatctttttcagcatatctgcctagcaaatgttttaaaattgacatttatttttagcactttcacttggtgaaggtggccatataaaattaaggaacatttgaacaatataagagaaaagaacttttaaggaacaattcacaaagtttgtttgaaattgtcagatgacatttcttgagtaccttttgtgtgcatagttattttagacaatataagctgttatggtcagcataacttaaaagtgtttagttttctattttactgagccttaaaaatagcactgatgagcttatgatacttaatgtttggcaatcataatgtgttcaaattaatgggattgaaaatctctccacacctgactctcatctgatctggatggttttggttttgtatcttttttacttctcccagaaaatactaaatttaaaactgtaaattaagaatataccactagataacaattatcaaattgagctttatgcatcattactcagaaagcttgccttcctttctttgctacttcaggacacagagttgacatttgcttactacagctttagatctagaagtttattcgtgcaacaaatatttattgagtaatttatactgtgccaggcatgttttgatatgtttctgtcatatgttttgatatgttccaacataagtttctgtcactttatattcagtatatattttctacagtgggtaaatttaacaaatggaaaggaatagaacactgatattttacagaattaaaccccttcattgtaagggctttgtttacatattaagtgtcaagtatttattcaggggatcttatttcattgtattttatctgttatctaggttgtccatttaccggttggacactgatactctgtcaaattcctttcaaaaatgactctttagtctgctgaaatttagcactagtactttagtgttctgatcctggaaaattcaaggtgaagctttatttgtggaccatctgatttaattattgaggattaaaaacctaaacctttgctcattctaaactcaagcttttaagcctcacagaatttacaggggtttgctttttgtttgtttgttttttcattttttactgtgcttattaaactcttggaattagttattaaagggagtaaattctcatcttgggaattttgaaaatctatggacttacaactttcaggaggattaaatgtcttaagttttgtactagagcagaatgaaatctttcctattcattgagtttttgcctgccatagaggaatttttttaaaaattaaaatgacagtttatattagtggcaaagtgaataaagacctcactttcccaccccacccttcttcctttctcttacttttctttggattaaaggtcaggtgtagtactatgaagattcactcctgaataaagtgatttcagaagctaaaatttaacatacctggaaattttgtgatgtgttagccaagtgaagacattagtgtgttccatcttttgctaatggttcatggttgatttcttcattgtttcccatgaaattagcatagtcaagtggtacccttgacgcttgactgctggtcagtttgaccctgtttttaacaactaatgtagtcatgccgcttgattattccatgaagtcccagcaaaataataatgaggaattaactaacattatgttatctatctaatttgtctgtgtccctaaatgcccatgcctaacttgcttctctagtttattccttctgtggagggattaaaacgtgggtgttgcaagttgccctaagctaaacatagttttcttacatctttttgggaaaaaaaatggaatgggaagtatgcaagattaagcaagagtgatttttttttttttttgacaaatcaggtggccttcctaaacatactaagaattatgttctttcatgtgtggagacacatttgtttgcagcactttaaaaaatatatatggaataaaagtttacatgttggccctctagggatctaattaaggacattaaagtacaattcttgagctactaaccatcagctcttcttaatcaaagattgccatcagtgtagagtgtatctattggcacaacattctggtgttttgataacagtagaactcaatttcagtaactattaggagcatggtctgtgccctagcattaaaaatgttacttattattatgtgaatatcttgtattattatacaatgcagtattcaaatttgtccttgtagtgcagagatgactgataatttctaaaagattcgatccttaaaacttgtttccaagcagacttataaggaagctgatttttgagtcagaggccttaaacgtgtcatatacaagtggcatcattttaagtccaaagtgaaacacttgatttgaataagctagtttataaactaaagctgttttcttatgttacagtatttcagcacatttcattccacataaaaagaatattaagtgtccctggttgtgggagagtgtttatttttctcaaaattatctagcattttgcttacagtgctttgaatgtttgacttaaaattattattgatgttgaattgtagggtgctgatttaggtcttgattcatacacatttaaaggaggttggtaaccccctcatggtagagtgaagggagaaaagggccaagaagacaaagtaccactgataaagaagagattgtcaaatagatgcattcctagtcatgaattacccttttccaaacatttttaaagcaatgcctttgtgtcaactcaacccttcttccccatttcttgtcatagaatgtagcatggccataggtgaaaaagcttatcattaaagtatgaaaccatgaattataagcattttgccatgatgcccttttatacatatgtttttaaaagtactaaccaacatataggagtttaggaatggtgaagatataatttgattaagttgtaggtaaacagaaaggatcatcttaggctcagaatttctaatatgattacatgagtctactttataaactggtataggctatgtaattagcccgtaagttacttaaaggaccaggggacctaatttttgtcagttttccagtcacattggtgccattcaggactccagctgtttacaggaaatatgtacttagcagaatagtatttttccttgaaaaaaatttgaattcagcctaaatacagaatgaatatgaatagtttgtgaaaagggttagagaacaacaatattcctatagtttctgtattaatgcagtagagacagaggttcctaacgcaaaaagaaaaccacaagtaaagaccgtcaaattagagctttagaatatgacttgaaaaagtagggatgggcaaaacagcataagaaaatattttttcttaatgcagatggacagtgttttcttgttttaaaaatgttttgcctatttgccagcattttttgaagtaatacactgctgctacctggaagatgtctaacttcattttctacaactcttatgtgattttgccattgtcattaagatgcattgattttatttatgaggtgtatgactttaaatatctaaatgctgtattaagtgacttgtttcaaaggaataaatgaagtgaaaacgt

SEQ ID NO: 34634 - DNA, 6291 bp, Homo sapiens
agactattcggtaggcgtcttgagagcgggtgtgccgggtgacgagaaaatgctgcaaagattaacgctctcattcctgaatcccagcagaacctcattagatccataaatgggaacgctgtatcatccgttgcagtcgtcttgaagaaccaaggaggaaaattgcaccagcaaaaaaaaattgagtcatgaaagatgtgaaaagatggaaacattacatataatttattcagaagcaaagtcttttacagtggaggggctgtccagccggacccgggtgcgggaactccagggccaaattgccgccatcaccgggatcgcccccggcggtcagcgaatcctcgtcggataccctcccgagtgcctggatctcagcaatggggataccattctggaagacttgcccatccaatctggtgacatgctgatcattgaagaagaccaaaccaggcccagaagttcacctgcatttactaaacgtggtgcttctagttacgtcagggaaactttgcctgtgcttaccagaaccgtggtcccagcagacaactcttgcctctttactagtgtgtactatgtcgtcgaaggaggagtcttgaatccagcttgtgcccctgagatgagacgcctcatagcacaaattgtagcaagcgatccagacttctatagtgaggcaatactgggaaaaacaaatcaagagtactgtgactggatcaaaagggatgacacttggggaggagcaatagagatatcgattttgtccaagttttaccaatgtgaaatatgtgtagtggatacacagacagtaagaattgatcgttttggggaagatgcaggatataccaaaagggttctgcttatttatgatggcatccactatgatccacttcagcgtaacttccctgatccagatacacctcctctgaccattttctcctctaatgatgatattgttcttgtacaagcactggaattagcagatgaagctagaagaaggagacagtttactgatgtcaaccgcttcaccctgagatgcatggtatgtcagaaaggattaactggacaagcagaagcaagggaacatgccaaggagacaggccataccaactttggagaagtgtgacctatgcatgaatgagggttgaagcctactacctcacacatccagaaggctctgggttttccaataagctatggtaaccctaaagaacaaaggatacaatgcttgaaccatccttttaacttaaaaccactaagacactgaaattccttgttaagattaaaattagtgtgcaagtttacagatgtgtgtctacagtggtaaactgtacatacatgcctctttctgctggagtgacagaataggtgatccttgccacctactgacactgacctgaaggttgagattgagtattataaactagcacccagcagctttaacttgtagaagaaagcatcacattttgggtaatgtggaaggcctcctgtgagtccactgggcatacgattgagattgagtattataaactagcacccagcagctttaacttgtagaagaaagcatcacattttgggtaatgtggaaggcctcctgtgagtccactggacatttaccacagtgtctccagtaactgagtctttttaaaaactctgaatgagttaagtttctaaattatgaattgattcatcaaatgaagatactcagaattgtccaaactgattttatattgcaatttggtagacattataaatgtgtgcttaaccactgataagtacatcacaagcaatttttacagggatgagtctcatccttgagaatgttatcacaaaacaggaactgattgtgccctgtttaagatctctagcatataaaacgtagaatgtatgagggaataggtgcctgagcagcttcctgaagctttaaaagaccgttggcctcgtgttttaatgcaattcatgtattggtctttgtcacattggataacattttaaagttaagcagggtacttttttaattgaaattccttgaaattcgagtcctcagttttttcttcatttgcgtaaagtttatcggggggaatttaattttctcagctttttgttaagagcacttcctccaaaaaatttttttcaagtaataatgctctgctttgggttggtttttgtaagattttttgcacacctaaagagtgtttgcttttgtgctagccttatccctccactaaagttattttaaataatttcacatttctgcaaattagcactttgcttatctgcaatcttttactttgatttttgaagttttaaagcaattggagtaatactgttgaatgaactagtttcacttccaaaatagaaaaaattgtaaatccttgccttatgcagctttctcagaattctgcttcttcctagtactagatgtgtagccatttgcttagtggactaatccgcaaggcacaccctctaaaacttagcttcactacaagatcttccagataaaagttttctacctcttttcttaattattctgatcagggatgctaaattataatttgttatgtattatctcacataatgtgaagaggcttaatgtgaagttttgttattttggtctcttttttattaagtatctcacttagaaattcagtggtatactttaaagcacttggatctttttcagcatatctgcctagcaaatgttttaaaattgacatttatttttagcactttcacttggtgaaggtggccatataaaattaaggaacatttgaacaatataagagaaaagaacttttaaggaacaattcacaaagtttgtttgaaattgtcagatgacatttcttgagtaccttttgtgtgcatagttattttagacaatataagctgttatggtcagcataacttaaaagtgtttagttttctattttactgagccttaaaaatagcactgatgagcttatgatacttaatgtttggcaatcataatgtgttcaaattaatgggattgaaaatctctccacacctgactctcatctgatctggatggttttggttttgtatcttttttacttctcccagaaaatactaaatttaaaactgtaaattaagaatataccactagataacaattatcaaattgagctttatgcatcattactcagaaagcttgccttcctttctttgctacttcaggacacagagttgacatttgcttactacagctttagatctagaagtttattcgtgcaacaaatatttattgagtaatttatactgtgccaggcatgttttgatatgtttctgtcatatgttttgatatgttccaacataagtttctgtcactttatattcagtatatattttctacagtgggtaaatttaacaaatggaaaggaatagaacactgatattttacagaattaaaccccttcattgtaagggctttgtttacatattaagtgtcaagtatttattcaggggatcttatttcattgtattttatctgttatctaggttgtccatttaccggttggacactgatactctgtcaaattcctttcaaaaatgactctttagtctgctgaaatttagcactagtactttagtgttctgatcctggaaaattcaaggtgaagctttatttgtggaccatctgatttaattattgaggattaaaaacctaaacctttgctcattctaaactcaagcttttaagcctcacagaatttacaggggtttgctttttgtttgtttgttttttcattttttactgtgcttattaaactcttggaattagttattaaagggagtaaattctcatcttgggaattttgaaaatctatggacttacaactttcaggaggattaaatgtcttaagttttgtactagagcagaatgaaatctttcctattcattgagtttttgcctgccatagaggaatttttttaaaaattaaaatgacagtttatattagtggcaaagtgaataaagacctcactttcccaccccacccttcttcctttctcttacttttctttggattaaaggtcaggtgtagtactatgaagattcactcctgaataaagtgatttcagaagctaaaatttaacatacctggaaattttgtgatgtgttagccaagtgaagacattagtgtgttccatcttttgctaatggttcatggttgatttcttcattgtttcccatgaaattagcatagtcaagtggtacccttgacgcttgactgctggtcagtttgaccctgtttttaacaactaatgtagtcatgccgcttgattattccatgaagtcccagcaaaataataatgaggaattaactaacattatgttatctatctaatttgtctgtgtccctaaatgcccatgcctaacttgcttctctagtttattccttctgtggagggattaaaacgtgggtgttgcaagttgccctaagctaaacatagttttcttacatctttttgggaaaaaaaatggaatgggaagtatgcaagattaagcaagagtgatttttttttttttttgacaaatcaggtggccttcctaaacatactaagaattatgttctttcatgtgtggagacacatttgtttgcagcactttaaaaaatatatatggaataaaagtttacatgttggccctctagggatctaattaaggacattaaagtacaattcttgagctactaaccatcagctcttcttaatcaaagattgccatcagtgtagagtgtatctattggcacaacattctggtgttttgataacagtagaactcaatttcagtaactattaggagcatggtctgtgccctagcattaaaaatgttacttattattatgtgaatatcttgtattattatacaatgcagtattcaaatttgtccttgtagtgcagagatgactgataatttctaaaagattcgatccttaaaacttgtttccaagcagacttataaggaagctgatttttgagtcagaggccttaaacgtgtcatatacaagtggcatcattttaagtccaaagtgaaacacttgatttgaataagctagtttataaactaaagctgttttcttatgttacagtatttcagcacatttcattccacataaaaagaatattaagtgtccctggttgtgggagagtgtttatttttctcaaaattatctagcattttgcttacagtgctttgaatgtttgacttaaaattattattgatgttgaattgtagggtgctgatttaggtcttgattcatacacatttaaaggaggttggtaaccccctcatggtagagtgaagggagaaaagggccaagaagacaaagtaccactgataaagaagagattgtcaaatagatgcattcctagtcatgaattacccttttccaaacatttttaaagcaatgcctttgtgtcaactcaacccttcttccccatttcttgtcatagaatgtagcatggccataggtgaaaaagcttatcattaaagtatgaaaccatgaattataagcattttgccatgatgcccttttatacatatgtttttaaaagtactaaccaacatataggagtttaggaatggtgaagatataatttgattaagttgtaggtaaacagaaaggatcatcttaggctcagaatttctaatatgattacatgagtctactttataaactggtataggctatgtaattagcccgtaagttacttaaaggaccaggggacctaatttttgtcagttttccagtcacattggtgccattcaggactccagctgtttacaggaaatatgtacttagcagaatagtatttttccttgaaaaaaatttgaattcagcctaaatacagaatgaatatgaatagtttgtgaaaagggttagagaacaacaatattcctatagtttctgtattaatgcagtagagacagaggttcctaacgcaaaaagaaaaccacaagtaaagaccgtcaaattagagctttagaatatgacttgaaaaagtagggatgggcaaaacagcataagaaaatattttttcttaatgcagatggacagtgttttcttgttttaaaaatgttttgcctatttgccagcattttttgaagtaatacactgctgctacctggaagatgtctaacttcattttctacaactcttatgtgattttgccattgtcattaagatgcattgattttatttatgaggtgtatgactttaaatatctaaatgctgtattaagtgacttgtttcaaaggaataaatgaagtgaaaacgt

SEQ ID NO: 34635 - DNA, 6086 bp, Homo sapiens
atggaaacattacatataatttattcagaagcaaagtcttttacagtggaggggctgtccagccggacccgggtgcgggaactccagggccaaattgccgccatcaccgggatcgcccccggcggtcagcgaatcctcgtcggataccctcccgagtgcctggatctcagcaatggggataccattctggaagacttgcccatccaatctggtgacatgctgatcattgaagaagaccaaaccaggcccagaagttcacctgcatttactaaacgtggtgcttctagttacgtcagggaaactttgcctgtgcttaccagaaccgtggtcccagcagacaactcttgcctctttactagtgtgtactatgtcgtcgaaggaggagtcttgaatccagcttgtgcccctgagatgagacgcctcatagcacaaattgtagcaagcgatccagacttctatagtgaggcaatactgggaaaaacaaatcaagagtactgtgactggatcaaaagggatgacacttggggaggagcaatagagatatcgattttgtccaagttttaccaatgtgaaatatgtgtagtggatacacagacagtaagaattgatcgttttggggaagatgcaggatataccaaaagggttctgcttatttatgatggcatccactatgatccacttcagcgtaacttccctgatccagatacacctcctctgaccattttctcctctaatgatgatattgttcttgtacaagcactggaattagcagatgaagctagaagaaggagacagtttactgatgtcaaccgcttcaccctgagatgcatggtatgtcagaaaggattaactggacaagcagaagcaagggaacatgccaaggagacaggccataccaactttggagaagtgtgacctatgcatgaatgagggttgaagcctactacctcacacatccagaaggctctgggttttccaataagctatggtaaccctaaagaacaaaggatacaatgcttgaaccatccttttaacttaaaaccactaagacactgaaattccttgttaagattaaaattagtgtgcaagtttacagatgtgtgtctacagtggtaaactgtacatacatgcctctttctgctggagtgacagaataggtgatccttgccacctactgacactgacctgaaggttgagattgagtattataaactagcacccagcagctttaacttgtagaagaaagcatcacattttgggtaatgtggaaggcctcctgtgagtccactgggcatacgattgagattgagtattataaactagcacccagcagctttaacttgtagaagaaagcatcacattttgggtaatgtggaaggcctcctgtgagtccactggacatttaccacagtgtctccagtaactgagtctttttaaaaactctgaatgagttaagtttctaaattatgaattgattcatcaaatgaagatactcagaattgtccaaactgattttatattgcaatttggtagacattataaatgtgtgcttaaccactgataagtacatcacaagcaatttttacagggatgagtctcatccttgagaatgttatcacaaaacaggaactgattgtgccctgtttaagatctctagcatataaaacgtagaatgtatgagggaataggtgcctgagcagcttcctgaagctttaaaagaccgttggcctcgtgttttaatgcaattcatgtattggtctttgtcacattggataacattttaaagttaagcagggtacttttttaattgaaattccttgaaattcgagtcctcagttttttcttcatttgcgtaaagtttatcggggggaatttaattttctcagctttttgttaagagcacttcctccaaaaaatttttttcaagtaataatgctctgctttgggttggtttttgtaagattttttgcacacctaaagagtgtttgcttttgtgctagccttatccctccactaaagttattttaaataatttcacatttctgcaaattagcactttgcttatctgcaatcttttactttgatttttgaagttttaaagcaattggagtaatactgttgaatgaactagtttcacttccaaaatagaaaaaattgtaaatccttgccttatgcagctttctcagaattctgcttcttcctagtactagatgtgtagccatttgcttagtggactaatccgcaaggcacaccctctaaaacttagcttcactacaagatcttccagataaaagttttctacctcttttcttaattattctgatcagggatgctaaattataatttgttatgtattatctcacataatgtgaagaggcttaatgtgaagttttgttattttggtctcttttttattaagtatctcacttagaaattcagtggtatactttaaagcacttggatctttttcagcatatctgcctagcaaatgttttaaaattgacatttatttttagcactttcacttggtgaaggtggccatataaaattaaggaacatttgaacaatataagagaaaagaacttttaaggaacaattcacaaagtttgtttgaaattgtcagatgacatttcttgagtaccttttgtgtgcatagttattttagacaatataagctgttatggtcagcataacttaaaagtgtttagttttctattttactgagccttaaaaatagcactgatgagcttatgatacttaatgtttggcaatcataatgtgttcaaattaatgggattgaaaatctctccacacctgactctcatctgatctggatggttttggttttgtatcttttttacttctcccagaaaatactaaatttaaaactgtaaattaagaatataccactagataacaattatcaaattgagctttatgcatcattactcagaaagcttgccttcctttctttgctacttcaggacacagagttgacatttgcttactacagctttagatctagaagtttattcgtgcaacaaatatttattgagtaatttatactgtgccaggcatgttttgatatgtttctgtcatatgttttgatatgttccaacataagtttctgtcactttatattcagtatatattttctacagtgggtaaatttaacaaatggaaaggaatagaacactgatattttacagaattaaaccccttcattgtaagggctttgtttacatattaagtgtcaagtatttattcaggggatcttatttcattgtattttatctgttatctaggttgtccatttaccggttggacactgatactctgtcaaattcctttcaaaaatgactctttagtctgctgaaatttagcactagtactttagtgttctgatcctggaaaattcaaggtgaagctttatttgtggaccatctgatttaattattgaggattaaaaacctaaacctttgctcattctaaactcaagcttttaagcctcacagaatttacaggggtttgctttttgtttgtttgttttttcattttttactgtgcttattaaactcttggaattagttattaaagggagtaaattctcatcttgggaattttgaaaatctatggacttacaactttcaggaggattaaatgtcttaagttttgtactagagcagaatgaaatctttcctattcattgagtttttgcctgccatagaggaatttttttaaaaattaaaatgacagtttatattagtggcaaagtgaataaagacctcactttcccaccccacccttcttcctttctcttacttttctttggattaaaggtcaggtgtagtactatgaagattcactcctgaataaagtgatttcagaagctaaaatttaacatacctggaaattttgtgatgtgttagccaagtgaagacattagtgtgttccatcttttgctaatggttcatggttgatttcttcattgtttcccatgaaattagcatagtcaagtggtacccttgacgcttgactgctggtcagtttgaccctgtttttaacaactaatgtagtcatgccgcttgattattccatgaagtcccagcaaaataataatgaggaattaactaacattatgttatctatctaatttgtctgtgtccctaaatgcccatgcctaacttgcttctctagtttattccttctgtggagggattaaaacgtgggtgttgcaagttgccctaagctaaacatagttttcttacatctttttgggaaaaaaaatggaatgggaagtatgcaagattaagcaagagtgatttttttttttttttgacaaatcaggtggccttcctaaacatactaagaattatgttctttcatgtgtggagacacatttgtttgcagcactttaaaaaatatatatggaataaaagtttacatgttggccctctagggatctaattaaggacattaaagtacaattcttgagctactaaccatcagctcttcttaatcaaagattgccatcagtgtagagtgtatctattggcacaacattctggtgttttgataacagtagaactcaatttcagtaactattaggagcatggtctgtgccctagcattaaaaatgttacttattattatgtgaatatcttgtattattatacaatgcagtattcaaatttgtccttgtagtgcagagatgactgataatttctaaaagattcgatccttaaaacttgtttccaagcagacttataaggaagctgatttttgagtcagaggccttaaacgtgtcatatacaagtggcatcattttaagtccaaagtgaaacacttgatttgaataagctagtttataaactaaagctgttttcttatgttacagtatttcagcacatttcattccacataaaaagaatattaagtgtccctggttgtgggagagtgtttatttttctcaaaattatctagcattttgcttacagtgctttgaatgtttgacttaaaattattattgatgttgaattgtagggtgctgatttaggtcttgattcatacacatttaaaggaggttggtaaccccctcatggtagagtgaagggagaaaagggccaagaagacaaagtaccactgataaagaagagattgtcaaatagatgcattcctagtcatgaattacccttttccaaacatttttaaagcaatgcctttgtgtcaactcaacccttcttccccatttcttgtcatagaatgtagcatggccataggtgaaaaagcttatcattaaagtatgaaaccatgaattataagcattttgccatgatgcccttttatacatatgtttttaaaagtactaaccaacatataggagtttaggaatggtgaagatataatttgattaagttgtaggtaaacagaaaggatcatcttaggctcagaatttctaatatgattacatgagtctactttataaactggtataggctatgtaattagcccgtaagttacttaaaggaccaggggacctaatttttgtcagttttccagtcacattggtgccattcaggactccagctgtttacaggaaatatgtacttagcagaatagtatttttccttgaaaaaaatttgaattcagcctaaatacagaatgaatatgaatagtttgtgaaaagggttagagaacaacaatattcctatagtttctgtattaatgcagtagagacagaggttcctaacgcaaaaagaaaaccacaagtaaagaccgtcaaattagagctttagaatatgacttgaaaaagtagggatgggcaaaacagcataagaaaatattttttcttaatgcagatggacagtgttttcttgttttaaaaatgttttgcctatttgccagcattttttgaagtaatacactgctgctacctggaagatgtctaacttcattttctacaactcttatgtgattttgccattgtcattaagatgcattgattttatttatgaggtgtatgactttaaatatctaaatgctgtattaagtgacttgtttcaaaggaataaatgaagtgaaaacgt

SEQ ID NO: 34636 - DNA, 1826 bp, Homo sapiens
ggcggatgtctccggcgcgtcggtgcagggggatgagggccgcggtggctgccagcgtggggttgagcgaggggcctgctggctcccggagcggtcgcctcttccgcccgccgagtcccgctccggcggcccccggcgcccggctgttgcggctcccggggagcggggccgtgcaggccgcgagcccggagcgcgccggctggaccgaggcgctgcgggccgccgtggccgagctgcgcgccggcgccgtggtggccgtccccaccgatacgctgtacggcctggcctgcgcggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctcgcagggagagcagtctttttggtgtaatagtgggatgtctgcttagttggcaggggttcagtccaaatggaagaatattgggaaataaacctccactatcctttatagccagggacttttttcttatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggt

SEQ ID NO: 34637 - DNA, 2925 bp, Homo sapiens
ggccggcctctcccttcccggggttcttcgcgccgggccccttccgcgtgggtgagtgaatgtgagagtcagcgctcgcgccgcgcgcgccgcccgcctccgctgttcggcgctctgctttaggcggtggggggcgggcgcgcgcgtaaaagcatagagacgggcattgagctcttgggctagagcgtcgccgagtcggagccggagcctgagccgcgcgctgtgtctccgctgcgtccgccgaggcccccgagtgtcagggacaaaagcctccgcctgctcccgcagacggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 34638 - DNA, 1710 bp, Homo sapiens
atgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaaggaagaagaaagtgttaa

SEQ ID NO: 34639 - DNA, 2718 bp, Homo sapiens
agagcgtcgccgagtcggagccggagcctgagccgcgcgctgtgtctccgctgcgtccgccgaggcccccgagtgtcagggacaaaagcctccgcctgctcccgcagacggggctcatctgccgccgccgccgcgctgaggagagttcgccgccgtcgccgcccgtgaggatctgagagccatgtcggccagcagcctcttggagcagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatc

SEQ ID NO: 34640 - DNA, 2825 bp, Homo sapiens
agtctttccaggtgttagtcgaaacctcgtggtgcgaccctggtcgtcccaaaccccctaggccttaatcctggggcggtgggggcggggaggccgtgagcacggcttccgctcctccaatccgccagagggcgcagcggccggcctctcccttcccggggttcttcgcgccgggccccttccgcgtggacggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatc

SEQ ID NO: 34641 - DNA, 6697 bp, Homo sapiens
cgaggcgaggcgaggcggggagccgagacgagcagcggccgagcgagcgcgggcgcgggcgcaccgaggcgagggaggcggggaagccccgccgccgccgcggcgcccgccccttcccccgccgcccgccccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggagcatactatttgtataaagaactgtcaccccagagtgacatttattttccaagatgaccctgaactcatgctgttggtttcatatggtgtttgtgtgctttgcctagattcaaggcctgaggatttgaggaaaatcgggattttttttttcctatttggttttcatgtaaaagttctaaatgtcacttattttgctaaataagaccctttcacaggatagtgtgcgcaatacctgtccgtgtttccaagcagagttcaagttcatgtcttcacaagtagatgagagtcacttccagtcgggggaagcccgcctgagcagtgttttgagagtgcgtacattggaggactgccccacgtccgtttgcactctgccttgcaaaacttactgtggagacgtgtcccagactggtctcagaccagagtttgtggcacaggaaaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctcccaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctgacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacacccagatgctgtaaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattatgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttttaa

SEQ ID NO: 34642 - DNA, 636 bp, Homo sapiens
ttctcgtcaaagcagactttattggggcgacagggccgccccgcacgcgccagccgctccccgcgcggcccccgggccgcccacccgcctcaaccccgctcccggccggcccctccctcccttctcctcaggctcccgcccccgtggtgcccggggccgcgcggaccgctcaccggctcccaaggcagcggctgtagcggcgacgccccgttcccgagtgcggccccggcccgaggcggcgggttttgtggctgttgcaccgcgaagggcggcagccgcgcgacaccgggaagcgggaggcggtggcggcggcggcggcgcgctgacgtcacgcgccgcgggccagccagggcgcgtgcgagccgccccgcccccggtcccatcggccccaatccgggaggagcccggcgagtgggcggggccgcggaggccagcggacagatcgattggccgagaggagaatcgagagggcgaacgggcgagtggcagcgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggag

SEQ ID NO: 34643 - DNA, 2225 bp, Homo sapiens
tttttttttctttcaaaagacgaacagagaagtttcattttctttttctcctgaaaccgaatctggccggcctggctaggcatctatttccgggctgtaagcagctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctgctgacccgggcagagaaggccaccttgaacaaagaatcctgcaggtgctgacagaggctggctccccggtgaaacttgcccagctggtgaaggaatgccaagcacccaagagggagctcaaccaagtcctctaccgaatgaaaaaggagttgaaagtctccctcacatcccctgccacctggtgcttgggcgggactgatcctgaaggcgagggtcctgcagagctggccttgtccagccctgaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggttccgccggtccacgccacctcccttcaatggcaccaggtgattcctcaacttgggggaccctagttgatccctgggggccccaggacatccacatggagcagtccatactgagacgggtgcagctgggacacagcaatgagatgaggctccacggcgtcccgtccgagggccctgcccacatcccccctggcagccccccagtctctgccactgctgccggcccagaagcttcgtttgaagcaagaattcccagtccaggaactcaccctgagggggaagccgcccagagaatccacatgaaatcgtgctttctcgaggacgccaccatcggcaacagcaacaaaatgtctatcagcccaggggtggctggcccaggaggagtcgcagggtctggagagggggagccaggggaggacgcaggtcgtcgtcccgcagacacacaatccagaagtcactttcctcgagacattggtcagcccatcactcccagccactcgaagctcacccccaagctggaaactatgactcttggaaacaggagtcacaaagctgcagaaggcagccactatgtggatgaagcctcacacgaggggagctggtggggaggtgggatttagtgcacagcctcacgtggggcttggacacaggctgggggtgggcgcatgctagggagactagcctgctgctctctgcattccttagcgtcttgtttgacctgcttgcttccagacataacctgcatgaatcagttttgggggaatggacctggcatggggatgggttcaggccaggtcttttgatggccaggagtagatgacagggagttgccttggggaacctttggtgtgccaagaggaggtgggtagatgggagtggggctcggtcccccaggcccaggggactctctccactctttcctgggctcggggcatctgcctggagttaccttccatcatggctacctgctgtggtttgaatgtttgagtcccaacaaaattcatatcaaaacataatcccaactgggtgcagtggctcacgcctgtaatcccagcactttgggaggccgaggcgggcggatcaataggtcaggaaatccagaccgtcctggctaacatggtgaaaccccgtctctactaaaaaaaaaaatacaaaaaattagccgggcgttgtggcgggcacctggagtcccagctactccggaggctgagggaggagaatggtgtgaacccgggaggtggagcttccagtgagccgagatcgcgccactgcactccaggctgggcgacagagcgagactccgtctcaaaaaaataaatacataaataaaaaataaaccaacc

SEQ ID NO: 34644 - DNA, 1622 bp, Homo sapiens
tttttttttctttcaaaagacgaacagagaagtttcattttctttttctcctgaaaccgaatctggccggcctggctaggcatctatttccgggctgtaagcagctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctgctgacccgggcagagaaggccaccttgaacaaagaatcctgcaggtgctgacagaggctggctccccggtgaaacttgcccagctggtgaaggaatgccaagcacccaagagggagctcaaccaagtcctctaccgaatgaaaaaggagttgaaagtctccctcacatcccctgccacctggtgcttgggcgggactgatcctgaaggcgagggtcctgcagagctggccttgtccagccctgccgagaggccccagcaacatgcagctacaattccagagacccctggccctcagttcagccaacaacgggaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggttccgccggtccacgccacctcccttcaatggcaccaggtgattcctcaacttgggggaccctagttgatccctgggggccccaggacatccacatggagcagtccatactgagacgggtgcagctgggacacagcaatgagatgaggctccacggcgtcccgtccgagggccctgcccacatcccccctggcagccccccagtctctgccactgctgccggcccagaagcttcgtttgaagcaagaattcccagtccaggaactcaccctgagggggaagccgcccagagaatccacatgaaatcgtgctttctcgaggacgccaccatcggcaacagcaacaaaatgtctatcagcccaggggtggctggcccaggaggagtcgcagggtctggagagggggagccaggggaggacgcagttgctgccttcactgaagtcttgaacccctcaaagtcattcatgaaatttggaatcaacttcttccagactcctgtgaatgttgatagtttgacctcctcccatgaatcacaaatgttcttaacggcatgtagattggtgatcttttccagaagattttcaacttactttgcccagatccatctgaggaatcactctgtgttgcacttatgccctcataaaatatatttattgaagaataagaagtga

SEQ ID NO: 34645 - DNA, 1424 bp, Homo sapiens
tttttttttctttcaaaagacgaacagagaagtttcattttctttttctcctgaaaccgaatctggccggcctggctaggcatctatttccgggctgtaagcagctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctgctgacccgggcagagaaggccaccttgaacaaagaatcctgcaggtgctgacagaggctggctccccggtgaaacttgcccagctggtgaaggaatgccaagcacccaagagggagctcaaccaagtcctctaccgaatgaaaaaggagttgaaagtctccctcacatcccctgccacctggtgcttgggcgggactgatcctgaaggcgagggtcctgcagagctggccttgtccagccctgccgagaggccccagcaacatgcagctacaattccagagacccctggccctcagttcagccaacaacgggaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggttccgccggtccacgccacctcccttcaatggcaccaggtgattcctcaacttgggggaccctagttgatccctgggggccccaggacatccacatggagcagtccatactgagacgggtgcagctgggacacagcaatgagatgaggctccacggcgtcccgtccgagggccctgcccacatcccccctggcagccccccagtctctgccactgctgccggcccagaagcttcgtttgaagcaagaattcccagtccaggaactcaccctgagggggaagccgcccagagaatccacatgaaatcgtgctttctcgaggacgccaccatcggcaacagcaacaaaatgtctatcagcccaggggtggctggcccaggaggagtcgcagggtctggagagggggagccaggggaggacgcaggtcgtcgtcccgcagacacacaagccaggtcttttgatggccaggagtag

SEQ ID NO: 34646 - DNA, 2195 bp, Homo sapiens
gctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctgctgacccgggcagagaaggccaccttgaacaaagaatcctgcaggtgctgacagaggctggctccccggtgaaacttgcccagctggtgaaggaatgccaagcacccaagagggagctcaaccaagtcctctaccgaatgaaaaaggagttgaaagtctccctcacatcccctgccacctggtgcttgggcgggactgatcctgaaggcgagggtcctgcagagctggccttgtccagccctgccgagaggccccagcaacatgcagctacaattccagagacccctggccctcagttcagccaacaacgggaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggttccgccggtccacgccacctcccttcaatggcaccaggtgattcctcaacttgggggaccctagttgatccctgggggccccaggacatccacatggagcagtccatactgagacgggtgcagctgggacacagcaatgagatgaggctccacggcgtcccgtccgagggccctgcccacatcccccctggcagccccccagtctctgccactgctgccggcccagaagcttcgtttgaagcaagaattcccagtccaggaactcaccctgagggggaagccgcccagagaatccacatgaaatcgtgctttctcgaggacgccaccatcggcaacagcaacaaaatgtctatcagcccaggggtggctggcccaggaggagtcgcagggtctggagagggggagccaggggaggacgcaggtcgtcgtcccgcagacacacaatccagaagtcactttcctcgagacattggtcagcccatcactcccagccactcgaagctcacccccaagctggaaactatgactcttggaaacaggagtcacaaagctgcagaaggcagccactatgtggatgaagcctcacacgaggggagctggtggggaggtgggatttagtgcacagcctcacgtggggcttggacacaggctgggggtgggcgcatgctagggagactagcctgctgctctctgcattccttagcgtcttgtttgacctgcttgcttccagacataacctgcatgaatcagttttgggggaatggacctggcatggggatgggttcaggccaggtcttttgatggccaggagtagatgacagggagttgccttggggaacctttggtgtgccaagaggaggtgggtagatgggagtggggctcggtcccccaggcccaggggactctctccactctttcctgggctcggggcatctgcctggagttaccttccatcatggctacctgctgtggtttgaatgtttgagtcccaacaaaattcatatcaaaacataatcccaactgggtgcagtggctcacgcctgtaatcccagcactttgggaggccgaggcgggcggatcaataggtcaggaaatccagaccgtcctggctaacatggtgaaaccccgtctctactaaaaaaaaaaatacaaaaaattagccgggcgttgtggcgggcacctggagtcccagctactccggaggctgagggaggagaatggtgtgaacccgggaggtggagcttccagtgagccgagatcgcgccactgcactccaggctgggcgacagagcgagactccgtctcaaaaaaataaatacataaataaaaaataaaccaaccataa

SEQ ID NO: 34647 - DNA, 1041 bp, Homo sapiens
cagaagccccagcctcgacctagcccaccctctcagggccacagtgcagaagcctgcacacctgccaagtctctccgactccttgcagctgctgtcagcatggcccaggctcctgctgacccgggcagagaaggccaccttgaacaaagaatcctgcaggtgctgacagaggctggctccccggtgaaacttgcccagctggtgaaggaatgccaagcacccaagagggagctcaaccaagtcctctaccgaatgaaaaaggagttgaaagtctccctcacatcccctgccacctggtgcttgggcgggactgatcctgaaggcgagggtcctgcagagctggccttgtccagccctgccgagaggccccagcaacatgcagctacaattccagagacccctggccctcagttcagccaacaacgggaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggtaagtcacccaagagagcccagggaggggacctcggtggggagccaccggatcctctgggtgggggcaaagggtagggatggggagtggggggattctgccctccaaggggaaagggttgcttccagacccccacagtccacctttacggccgtcctgagaatgaggacacctggatcaaagctctcctgatttccctgtactctgatactttctacctcattttaaagtttaatttaatttttatttttctaataaaattttaaaattaa

SEQ ID NO: 34648 - DNA, 2073 bp, Homo sapiens
tttttttttctttcaaaagacgaacagagaagtttcattttctttttctcctgaaaccgaatctggccggcctggctaggcatctatttccgggctgtaagcagctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctgctgacccgggcagagaagccgagaggccccagcaacatgcagctacaattccagagacccctggccctcagttcagccaacaacgggaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggttccgccggtccacgccacctcccttcaatggcaccaggtgattcctcaacttgggggaccctagttgatccctgggggccccaggacatccacatggagcagtccatactgagacgggtgcagctgggacacagcaatgagatgaggctccacggcgtcccgtccgagggccctgcccacatcccccctggcagccccccagtctctgccactgctgccggcccagaagcttcgtttgaagcaagaattcccagtccaggaactcaccctgagggggaagccgcccagagaatccacatgaaatcgtgctttctcgaggacgccaccatcggcaacagcaacaaaatgtctatcagcccaggggtggctggcccaggaggagtcgcagggtctggagagggggagccaggggaggacgcaggtcgtcgtcccgcagacacacaatccagaagtcactttcctcgagacattggtcagcccatcactcccagccactcgaagctcacccccaagctggaaactatgactcttggaaacaggagtcacaaagctgcagaaggcagccactatgtggatgaagcctcacacgaggggagctggtggggaggtgggatttagtgcacagcctcacgtggggcttggacacaggctgggggtgggcgcatgctagggagactagcctgctgctctctgcattccttagcgtcttgtttgacctgcttgcttccagacataacctgcatgaatcagttttgggggaatggacctggcatggggatgggttcaggccaggtcttttgatggccaggagtagatgacagggagttgccttggggaacctttggtgtgccaagaggaggtgggtagatgggagtggggctcggtcccccaggcccaggggactctctccactctttcctgggctcggggcatctgcctggagttaccttccatcatggctacctgctgtggtttgaatgtttgagtcccaacaaaattcatatcaaaacataatcccaactgggtgcagtggctcacgcctgtaatcccagcactttgggaggccgaggcgggcggatcaataggtcaggaaatccagaccgtcctggctaacatggtgaaaccccgtctctactaaaaaaaaaaatacaaaaaattagccgggcgttgtggcgggcacctggagtcccagctactccggaggctgagggaggagaatggtgtgaacccgggaggtggagcttccagtgagccgagatcgcgccactgcactccaggctgggcgacagagcgagactccgtctcaaaaaaataaatacataaataaaaaataaaccaaccataa

SEQ ID NO: 34649 - DNA, 2437 bp, Homo sapiens
atccaggaaataggttagtttcagacaagcctgcttgccggagctcagcagacaccaggccttccgggcaggcctggcccaccgtgggcctcagagctgctgctggggcattcagaaccggctctccattggcattgggaccagagaccccgcaagtggcctgtttgcctggacatccacctgtacgtccccaggtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttg

SEQ ID NO: 34650 - DNA, 1844 bp, Homo sapiens
atgcgcttggggccgcgctggaagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttg

SEQ ID NO: 34651 - DNA, 1085 bp, Homo sapiens
tgcatgctccagggacggcacccttgtctggggcaggtgcttgtgggggctgaggctgccttgctccccacacccctgcccctgacctgggagtgtaccgctgtgtgtgcccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctga

SEQ ID NO: 34652 - DNA, 5241 bp, Homo sapiens
atgattgctgctatcagtctcgcgctcaccgcccggctgaggaggtgaaagtttctccccaggaagataaaccgcaaaagacaatattgtgcatgatttgcgccttttctttggctttttctttctttcttcacccccccacccacttttttttttttttttttcaaaaagcagagagggaaaaacggagagtgaaggagcgaggaggcgagcgtgagagaaaggagagagagagaaaagaaagggcgaggggctagtggagaagtaaggaggggcgcgctgcgcgaggcggagagagggcgaagcagtcgcggcactggcgctcacattcctctatgctacaaatccaggaggaagtttttttttagggggctgagatgctccatgcctttccccgggcagccttgacgcgcggccctctcggcagagactgagcggcgagaaagtgcgagccgggccggcagaatctgcctggcgggcgctggagcctgcgttactcgcggcccgcagccgtccggctactttgcgtttggcccggccagcgcccgggcgcgccgcgccattgcctgcaggctaggacttcgcgaggtgggtcgactccccctccctcctcctcttcttcctcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacggccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctcttccccgggcttcacgagcaggctgccggccacgcgtcgcctaacgtggtcaacgggcagatgaggctcggcttctcgggggacatgtacccgcgaccggagcagtacggccaggtgaccagcccgcgttcggagcactatgctgcgccgcagctgcacggctacgggcccatgaacgtgaacatggccgcgcatcacggcgccggcgccttcttccgctacatgcgccaacccatcaagcaagagctcatctgcaagtggatcgagcccgagcagctggccaaccccaaaaagtcgtgcaacaaaactttcagcaccatgcacgagctagttacgcacgtcaccgtggagcacgtaggtggcccggagcagagtaatcacatctgcttctgggaggagtgtccgcgcgagggcaagcccttcaaagccaaatacaaactggttaaccacatccgcgtgcacacgggcgagaagccctttccctgccccttccctggctgtggcaaggtcttcgcgcgctccgagaatttaaagatccacaaaaggacgcacacaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttcgctgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagactgatcacacacgtatacacaacattactgaaagaaccctgcgaatcaaaacaacccccacacagaccccgcaatccttttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctccgtgattgtggtaggaatttcttcttcacccaccagcaacctgctgcctcttctgccagtcttaaagggtctccagaaaagctctccagtctcccttgccttccctttctgtcactgcaggtcgtataaacgtgataaatgaatgctaccctgctggctctccgagagagtgtaattagtatttatatcaaaatttatgaaacaaattttcggccgcagtataatttaaatgacctttgcagatgtagaataacaaccataaaaataacaggaatagattgcacaggcgacatcaatattaatgtagacgaattgtcagaagctcaggggctcgctctgcaacattgcaaatgaacttgcagccgagggttccgctgccccctagattaaattccccgggctgaaactgagttgcagatttacaatatcatattttaaattgctgtcttcaattaaaccatttatgaccataactaattttcaggatgtcgatgcatgcttttccaggccttccttctttgtacaaaagtaaatgtccataaagcgtttcacttatattcttcaaacatgatgctaatttaaattaattacttcctatgatatgttattattcctatgattttgccactgttattagttctctcaaaaatacatctagggaagaggattattttaagtaatttgattatctttctatctcttttatttatttctcatttacttaagaaattcgttccattggttggcattgatacagtaaatttgtaaatgaggagacaatataaaaaatctaaattacttgtgcttaatgactgtagcagaatgccttttctctaaatcagattgtctttcttgcagtttagtttgatagatttgcaagctatgctgcttccatgaagttagctgcgctggtaggaacgcaggcttctttgtctctggttgtagcttgcatgatcgccccattaggcagacaacgtagccggagatcacaaatcaggcccttggctgtagttgctagtgtgtggaggtgcagagcaggtggcagaaactgacctcactgggcaagggtggccatggacctgattctttaatgcactctatgtgttcaggaagccacaggccatatttgactctgagaaagaaaacaagaggaaaaaccccacaaagtataacaaccccttaagatacatctattttaaagtgaaattaatttttcagtttataccattggccaattacaagataaaaatgttcaatttctttaagaatcctttgttgacttgtcttttcatctcttgctatttatatttgtcactgtttcaacaaagtcttatttgctgaggaaggactttgctgcacttactgtaccacatcaaacactggggagggtggtgtttaactttttaaaaaatgttattctgattataacaataatattggcttttttcatgaaaagagcgccaccttgcaaggtttagtgagatttatggaagttgaatacctaagcaggaattgctgctagctccaaaaatttgcgaagcaaaagctagccccaattggtttggaagtttgaaactgattaacagatttgcatttgaagtgactccagacattaggtccagacattagttaaaaatagaaagaggaataaagacatctcttctctctagaaaagataacaccacaattaataatccttcccactttcattgagatcagcttgtctgataacctgatatgagtgtgataatgataaacatgataatagtggtacttttgtaattttgctggtgcatttaagaagatagtaaatgatgagttcatcttttcttcgaacattcctattcctagatgtagtttacctcaaattgggaattataactgtctaatttttgttgtgtacctgatgccccttttgctttaataccacagtgtaacaattaaatatcacactatgacatatgatttaagtaggatattttaaagataaattttaggggtaaatgtttacttcaaaatgactccatatttcaaatatctgtttagactgtgaaggccaaataatttttaagaaaacatttgaagagtagtgtgtttgcatttgtgaataatcttactcacagcaagtaaacgtaataaaagccaacatttaagccaa

SEQ ID NO: 34653 - DNA, 2974 bp, Homo sapiens
ccgcctggctttggactcttctcctcctccacctcctcctcctcctcccgcgccgccgcctcctcctcctcttcctctccgcgccttcgctacgcgcccggccgcccgaggcagatccaggcggcggcggaggcggcgggcgcaggagagcggctcccagggctgaagtggccgccaccaccgccgcctgcgcctggagcccggtggccgccggacgcaccgcgcggatcgggagcgggagtcgaggcggcgcggaggcgcagggctcgcaggggcgggcgggcgcgctggccatgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgactccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgc

SEQ ID NO: 34654 - DNA, 1928 bp, Homo sapiens
cctccacctcctcctcctcctcccgcgccgccgcctcctcctcctctcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgc

SEQ ID NO: 34655 - DNA, 783 bp, Homo sapiens
atgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgactccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccctgttcccagtcttctgacaaactgtgtacatagcggactcctcctttctcctccgaggtggttttaa

SEQ ID NO: 34656 - DNA, 3469 bp, Homo sapiens
ttactctggaggcgaagaggctgggactcgcgcggcgagcggcaagcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaatgtgtttgtcctggattttcggcatgcaaatcaaatattactgatcaattcagttagtggccatgacatctcaatcttgtacttcaaagactgagaagctggatttaatcatccctgccctacatatataaacataaggtaacctactgaattttatgtcccttagttctttattaccttacataaaaatgaaaattgcggcaggatgcatgtctgtctgttctatctagagatcacccatatacctatatatgtttgtatctatgacttatctaatctgcctatcaatctatctagtagctatctatatattttcaaaagatagcttatgtctaaaacagtggtgatgagtaaggccagttgagcattgcttacttatggttaaagtgcttcttaaaagaaccatagtccatttacaattttggaaggcaaaggctgatttgtttgctgtatatagttcaattcataattatcgcaattatccataacatttatatagcggtgtaataactgc

SEQ ID NO: 34657 - DNA, 1968 bp, Homo sapiens
gcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaagtgttgtcctgcttggtatccgggacagtctctaattcctgacgaagaacttgatactgacgttggtatgcagcagccagccctccataacactacctatcctaaatgcagggttaatgccgaacctactgtgcaagaaatgatttactgatgaggtttcaaagaaaaccacatcaatttggatgtctgttaccttgaagtgatcattttaagagtagtagcttcttccctaggtataaaaagactattttcttcttttggtgtatttcatcctgtgttgagcaatcatttgtgaaatgaaaaagcaaaaaaactccccccactttaggatttataaatgggaagatggaggtgaagactggcctaattcataacccagtatgcattatctcatgcattgtgttgaccttggtgaaaatctttttcaaataccagcattctatatgtagaactaaagtgtttaaaactagaaacatgaattgttgttttgttaattttatgtttgtgttcagaaagcaatacccaggatccctttaatttttgtttgacttaaataaaaccatttaaatta

SEQ ID NO: 34658 - DNA, 4331 bp, Homo sapiens
acacaacaagggaggggacctaaggggggaagggtagctgttgggagggggagagggaaaataattcttcaaaaaagaaaagtcagtcttctcctctccagtccgtggaaaatccaacggggacgttgacaagagggtatttttaggaaacacatccaaatatacagggtaagagtgaatgtgagaaaaaaaaaagttgtgggttgtagaagttatcaagtgggatttgcggcgctctctgcaggaaacgcgaacggctccagttcaaagccacatgcaccaacgtgacatataagccattaaaatatcatcctgacggctcatttctgcttcatcatacattccctaactgcttcctgaaagctggaaaaggagaagtgaaggatgaccgcctcgctggaaccacaaaagagaggcttggaggggtttgtggtcccctctcagccaccccgaaatgatgtgcagaaatgaggcgatcctggcaacaggtggagtggggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtgaaaaaaaaaatcaaacagtggagtcttctttagtgccagtccttgtggttgaataaaaaggatggtccgctttctattgagctgagaaatctttgaagtgggagttattatctgagacattcctgcttgtcgtcctaacaacgctgatgaaacgtaaaaggttctttgtcagcgatttgttctcctctctgtcaaactccctctgccccgttagtttcaaaccgtttctaaagagataaaaatcaaacttcttttaaaacaatatccacacactgcatcaatacataactttaggtctaagtcttgctaagggataaacaaaagcaatgcctagacatcagggtcagggcctggtctggtgaagtatgcagaagttggggggccctcgggacaagctttgggacatgaggaaaagaatgcagagagggtgcaagcagaatacataccctaagtccataattgtgtttctgcttctttctgctctggtttgcattcaatcagcccaagttgggtcacatagatgggtttcctttgggtacccctcaggctcctaatattcttgcccaggatccttggaacttaagaatgcagccaagcaattgttaatatctcctgctccttcaaagccacctctgctaaaaatagacccattgtgtgtttcttctcactagcagcaatcaacaagccctttctgccgttaataagaaggagaatagctgaaggagagagatattttattaatttcctgtttccttcagaatcttggcaattgaagtttagaaggtttggtctacaacacagtgatcgaaaatgcatgtaaatgcccatccttcccttcattcacgtgtgaagttgttcattttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaaggtctccatatgtttgtttatattgctaatttatgagaaaatgtaataattgcaatgaatgtgaattatacagacaggcaaacattttgtaatcataattcacatatacacaaaagcctggctgaaatctttagactatttgtaccctctctacccacactgtttgtgatttatcatctgtctctttagtgtcagttaaattatgaactaacttgaaaataaaagttgtttgactgaaagtgattgttgaatgaacaacaaagttgaaagccatggcttgatcttgtaaatatataaatgtaaatgatattaaatctgtgattccttttccctccaaaggcttttgtgtacatggcgctgcatttggctattttctttggaaataaataatgtgatgtttctcttcctcttttgaa

SEQ ID NO: 34659 - DNA, 3979 bp, Homo sapiens
gaaagaaagctaggactggctcaaaggttggatctgaaagttggggttgatgaatggcccatgtcaaagtcttaggaaagcggaggggcttttggagggttgcacttcggccgtcaccgtcttcaggaaactccctttggattccaaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtgaaaaaaaaaatcaaacagtggagtcttctttagtgccagtccttgtggttgaataaaaaggatggtccgctttctattgagctgagaaatctttgaagtgggagttattatctgagacattcctgcttgtcgtcctaacaacgctgatgaaacgtaaaaggttctttgtcagcgatttgttctcctctctgtcaaactccctctgccccgttagtttcaaaccgtttctaaagagataaaaatcaaacttcttttaaaacaatatccacacactgcatcaatacataactttaggtctaagtcttgctaagggataaacaaaagcaatgcctagacatcagggtcagggcctggtctggtgaagtatgcagaagttggggggccctcgggacaagctttgggacatgaggaaaagaatgcagagagggtgcaagcagaatacataccctaagtccataattgtgtttctgcttctttctgctctggtttgcattcaatcagcccaagttgggtcacatagatgggtttcctttgggtacccctcaggctcctaatattcttgcccaggatccttggaacttaagaatgcagccaagcaattgttaatatctcctgctccttcaaagccacctctgctaaaaatagacccattgtgtgtttcttctcactagcagcaatcaacaagccctttctgccgttaataagaaggagaatagctgaaggagagagatattttattaatttcctgtttccttcagaatcttggcaattgaagtttagaaggtttggtctacaacacagtgatcgaaaatgcatgtaaatgcccatccttcccttcattcacgtgtgaagttgttcattttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaaggtctccatatgtttgtttatattgctaatttatgagaaaatgtaataattgcaatgaatgtgaattatacagacaggcaaacattttgtaatcataattcacatatacacaaaagcctggctgaaatctttagactatttgtaccctctctacccacactgtttgtgatttatcatctgtctctttagtgtcagttaaattatgaactaacttgaaaataaaagttgtttgactgaaagtgattgttgaatgaacaacaaagttgaaagccatggcttgatcttgtaaatatataaatgtaaatgatattaaatctgtgattccttttccctccaaaggcttttgtgtacatggcgctgcatttggctattttctttggaaataaataatgtgatgtttctcttcctcttttg

SEQ ID NO: 34660 - DNA, 929 bp, Homo sapiens
gcagaggatgagtccatcccttcttcccaggaggagggaaaaggggtacaaatggggctcccactggcacaggaaccaggagcagtttgttgcctgcctgccttcccttctctccttgtgaattgcctgggtgccccaccgtgggcacaagaatggaagtcgtggcccagagcttccctcgcgaaaaatgagcaaggcgggtgccgggagggggcctttacaggaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacag

SEQ ID NO: 34661 - DNA, 565 bp, Homo sapiens
gcttcatcatacattccctaactgcttcctgaaagctggaaaaggagaagtgaaggatgaccgcctcgctggaaccacaaaagagaggcttggaggggtttgtggtcccctctcagccaccccgaaatgatgtgcagaaatgaggcgatcctggcaacaggtggagtgggggtcaaagcgccaagttagcccagatggcagcaagacgatggaacttctccgccccaacctgacggcagatgccgcctgagtccacctcagggcggctccttgccctccctcaccctggtcctgcctcaggaagctgactgctgggatctgctctctgcgcgcggccagcagtgggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctg

SEQ ID NO: 34662 - DNA, 1481 bp, Homo sapiens
gaaagaaagctaggactggctcaaaggttggatctgaaagttggggttgatgaatggcccatgtcaaagtcttaggaaagcggaggggcttttggagggttgcacttcggccgtcaccgtcttcaggaaactccctttggattccaaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaa

SEQ ID NO: 34663 - DNA, 1774 bp, Homo sapiens
gagaagtgatccagacctcttagaagttgggttggggctgccttatgggtggacagggatctctagggaacctcacacccatttcccccagaagcaaaagagtaaattctattattgccaaccaaccaggacttttccatgccagacatcctgccatgaggaaatttcagagcgaggacgcccagcatgccgcccttctgtaggaatgcaaagttaggcctcctttctttcctgatttgtgctggaaggagcttattacctttggggaagaatgccttttggttagaaagaattgaaaataataataccctctgggaaaaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcaga

SEQ ID NO: 34664 - DNA, 500 bp, Homo sapiens
ccacttggatttggcctgtggttcaacaagttaaacaactgcttgttctgtgggcagacatccccattgacagaggacttgctgtgtttgtccagcctgagaccttttcaatgactgtttttctttctaggccaaattgagggtgggggccggatagatgcttctgtctggctgctcaactgcctcagccttgcctgacagatgcagaggtcctcaggatggctttaagtatttaaggcggccaatggcttggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagccctt

SEQ ID NO: 34665 - DNA, 4152 bp, Homo sapiens
gagaagtgatccagacctcttagaagttgggttggggctgccttatgggtggacagggatctctagggaacctcacacccatttcccccagaagcaaaagagtaaattctattattgccaaccaaccaggacttttccatgccagacatcctgccatgaggaaatttcagagcgaggacgcccagcatgccgcccttctgtaggaatgcaaagttaggcctcctttctttcctgatttgtgctggaaggagcttattacctttggggaagaatgccttttggttagaaagaattgaaaataataataccctctgggaaaaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtgaaaaaaaaaatcaaacagtggagtcttctttagtgccagtccttgtggttgaataaaaaggatggtccgctttctattgagctgagaaatctttgaagtgggagttattatctgagacattcctgcttgtcgtcctaacaacgctgatgaaacgtaaaaggttctttgtcagcgatttgttctcctctctgtcaaactccctctgccccgttagtttcaaaccgtttctaaagagataaaaatcaaacttcttttaaaacaatatccacacactgcatcaatacataactttaggtctaagtcttgctaagggataaacaaaagcaatgcctagacatcagggtcagggcctggtctggtgaagtatgcagaagttggggggccctcgggacaagctttgggacatgaggaaaagaatgcagagagggtgcaagcagaatacataccctaagtccataattgtgtttctgcttctttctgctctggtttgcattcaatcagcccaagttgggtcacatagatgggtttcctttgggtacccctcaggctcctaatattcttgcccaggatccttggaacttaagaatgcagccaagcaattgttaatatctcctgctccttcaaagccacctctgctaaaaatagacccattgtgtgtttcttctcactagcagcaatcaacaagccctttctgccgttaataagaaggagaatagctgaaggagagagatattttattaatttcctgtttccttcagaatcttggcaattgaagtttagaaggtttggtctacaacacagtgatcgaaaatgcatgtaaatgcccatccttcccttcattcacgtgtgaagttgttcattttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaaggtctccatatgtttgtttatattgctaatttatgagaaaatgtaataattgcaatgaatgtgaattatacagacaggcaaacattttgtaatcataattcacatatacacaaaagcctggctgaaatctttagactatttgtaccctctctacccacactgtttgtgatttatcatctgtctctttagtgtcagttaaattatgaactaacttgaaaataaaagttgtttgactgaaagtgattgttgaatgaacaacaaagttgaaagccatggcttgatcttgtaaatatataaatgtaaatgatattaaatctgtgattccttttccctccaaaggcttttgtgtacatggcgctgcatttggctattttctttggaaataaataatgtgatgtttctcttcctcttttg

SEQ ID NO: 34666 - DNA, 4017 bp, Homo sapiens
gctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctggcaactgtgtctccctgtgctatatttaattccaccagcaaagctggcgaggcagggcccagccctgaaggagatctccttgcctgacccctggacctggaaatggaggcttcatgtgcccgccttggcggcttaagcctgctgctttggcagtgccatgggtgagccgagcagctgtgaggtgggtggggcagggctgtagcccacgccgggtgctattccaggctctaggggctggtgctcatccccacccccagcgacttccgtcctacctggcatgctgcagccctctgccggctgtggtgtcctctgaatttggacccaggttgcctgctcttgttgtgggggtgggattggggctgtctgtgtttcccaggtggagctcatgtttgtgatcctctatctggacagctctccagaatcctgtgttgcccctgttctgcctttctgggatgggagagaaggtgagggagccggcgagcaggttctaccctctctgctaagggcctagcacactttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtca

SEQ ID NO: 34667 - DNA, 2222 bp, Homo sapiens
cagcgaggggtgcctgcagccgggaccccttcctctccgcgtctcctcgtctcccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggaggatttaagtgccctgtatgctcaaaatttgtatcctcagatgaaatggatttgcatcttgtaatgtgtttaacaaagccacgaataacctataatgaggatgtactgagtaaagatgctggggaatgtgcaatatgccttgaagaattgcagcagggagatactatagcacgactgccttgtctatgcatatatcataaaggctgcatagatgaatggtttgaagtaaatagatcttgccctgagcacccttcagattaagcgtcagcttcctgttttataggttttcttgtcttgacaagatgcttgaaaaaccaagaggatatgaaaatctgtctctggagaaacaaagacgcaggcatactcagccagaaatctgagttttgtgagacttggtaatacagagatggacaatcgtactggggtaaaaaaaccctgctgaagagaggacagtgaccacagaactcagtgtaccaaacatgcatacaaaggacacacagggattttgaaaatgctgcacatcccttaatagtcatctacataggtaatactgataaacattttgtattcagacgccaaagttaactgatttaaaagttgatttactttttattaagttctccagagctgcacaactagttatgttttgatttgttttgttttttaatttggggtctctttgttttccccaacataatgttcataatgtttctgcattcatctgttcttaaattgaaaaacatataatttacttcttataaattgaagtcttaaatgtgaaaccaagaaatgtaatcaagcagtaaaaacatctgaatgtagaccatgatctcaagttcttccattttctcccccacgagtggaaaatagacttctacataggaaagctaaaatatgttaatatttttaaattaaaggtttaatatcagaatgcagtccaaagagcaaatcatattacataattacattttaattaaatatagaatattctactgaattgcaatttattaaatattcttatcctcttaaataaaactgctcaacagttaatcagcagtgaatcatcttgcagctatgcaatttaaaaaaaatacagattaccaatttcaagtgctgccagctaaaataactgttttaacgggtatcttttgtttgttcttttcacttaattattttattgtgctttgcatctccaggcagttctctcacatttgggtaaaatgtttagcaggctgtaaacttaagaaaagggtaaaataaaattttctggagaggaacttggaatttgagggagattttatatacctttaaaaactgtaatttaattgggatgccaggtttatagcaatttgcaactttaattttccagataatctggaggttagcatttgataaatgattttttaaagtagatatgaagattttgttaatttataatttattcatgtgttattactgtaattgaaaatgttatagacacttttaaattcagtttgtgtagaaagaaatgtgttaaacaaaattatgttaataaatattcccacataatacatctgaatggttaaaaatactggaagagttgtcagggctacaatagtgaatgtccttttttttaatatcaaaaatatcgataagtaggttttgtgttttcaacgtagggaaaatgttatcagtgaataggtggtgtactttacttggtataatttaaagttgcacagtaagtactgtttccttattttaatctttctttactcataatgtatttaagaatttgctgttttatttaacgctgctactcttaatcttctctaaatttttccccctactttcttgcttctgtttcacattttttaaaagggcaagtacaggagcaactgctgctacccagaaaaatgtgtgtattataaataattaaagagtttttaattgctttctgtatg

SEQ ID NO: 34668 - DNA, 3460 bp, Homo sapiens
gcgggccacgtgcgggaggaggggccgccttctggttggcgcccggtgtccgttcctcctatcggcgtaggccccgcgaggaagacaagggcgcgccctggctgggagggcgtggccagagacctgtccatcaccgagtccacgagtggcagcacctaccacaccgcagtaccttggcgaggcggagcaggggcaggcaggtcgcggaagggggaggcggagcaaggccggcgggagccaatcggcctggcggcacgagggggcgggggcggggtcaacgcgcgcgacccaaacacacgggccgggcgcaccctgcagccgcgccgctccgcggccttccggcgcggggccggggaacctcctccccatctgcgcaccccccgccttcgcggcccagatcctcccgccagcccggcccctccttcgcagggggagcgaggcgacggttgccgggaagcgcgcgccacctctccctcccatttttcgttctcccctcgcgcgccacccgtttttcctctttctccgttaataacagctgggtggctgggggaggagggaaggtggccccggcggagtctgggcgggcgcctcccactcagccgccagccgccgtgggagccggaggatggcggcggtagcagcggccgcccgagaggaggcggtgccgagatcgggggcgccgagcgcggcagcagagagcggtagcggcccgtcgtggcgcaccagaaccgaaaccagcggcagccgcacggccacttgagccgccccttcctgctggagccagcgaggggtgcctgcagccgggaccccttcctctccgcgtctcctcgtctcccgcgcccgcgtcaggccgtcggcctcgcccgccgccccaagaagagcgcgccgggcgccgactgcccctctggacgccgggcggcggccctggacgtgcgggggcctctctgggccggccgcggcgcctgggccctgccctctagctcccgcgctcgctcccgccctcccggctctcggggcgcagcgcgcgggcccggcccggggcagggcggacatgggcgccaaacagagcggcccggccgccgctaacggccgcacgcgcgcgtactcgggctcggatctaccttccagtagcagcggaggcgccaatgggaccgcgggcggcggcgggggcgctcgggccgccgccgcggggaggttcccggctcaggtgcccagcgcgcaccagcccagcgcctccggcggcgccgcggcggccgcggcggccccggcagccccggcggccccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggaggatttaagtgccctgtatgctcaaaatttgtatcctcagatgaaatggatttgcatcttgtaatgtgtttaacaaagccacgaataacctataatgaggatgtactgagtaaagatgctggggaatgtgcaatatgccttgaagaattgcagcagggagatactatagcacgactgccttgtctatgcatatatcataaaggctgcatagatgaatggtttgaagtaaatagatcttgccctgagcacccttcagattaagcgtcagcttcctgttttataggttttcttgtcttgacaagatgcttgaaaaaccaagaggatatgaaaatctgtctctggagaaacaaagacgcaggcatactcagccagaaatctgagttttgtgagacttggtaatacagagatggacaatcgtactggggtaaaaaaaccctgctgaagagaggacagtgaccacagaactcagtgtaccaaacatgcatacaaaggacacacagggattttgaaaatgctgcacatcccttaatagtcatctacataggtaatactgataaacattttgtattcagacgccaaagttaactgatttaaaagttgatttactttttattaagttctccagagctgcacaactagttatgttttgatttgttttgttttttaatttggggtctctttgttttccccaacataatgttcataatgtttctgcattcatctgttcttaaattgaaaaacatataatttacttcttataaattgaagtcttaaatgtgaaaccaagaaatgtaatcaagcagtaaaaacatctgaatgtagaccatgatctcaagttcttccattttctcccccacgagtggaaaatagacttctacataggaaagctaaaatatgttaatatttttaaattaaaggtttaatatcagaatgcagtccaaagagcaaatcatattacataattacattttaattaaatatagaatattctactgaattgcaatttattaaatattcttatcctcttaaataaaactgctcaacagttaatcagcagtgaatcatcttgcagctatgcaatttaaaaaaaatacagattaccaatttcaagtgctgccagctaaaataactgttttaacgggtatcttttgtttgttcttttcacttaattattttattgtgctttgcatctccaggcagttctctcacatttgggtaaaatgtttagcaggctgtaaacttaagaaaagggtaaaataaaattttctggagaggaacttggaatttgagggagattttatatacctttaaaaactgtaatttaattgggatgccaggtttatagcaatttgcaactttaattttccagataatctggaggttagcatttgataaatgattttttaaagtagatatgaagattttgttaatttataatttattcatgtgttattactgtaattgaaaatgttatagacacttttaaattcagtttgtgtagaaagaaatgtgttaaacaaaattatgttaataaatattcccacataatacatctgaatggttaaaaatactggaagagttgtcagggctacaatagtgaatgtccttttttttaatatcaaaaatatcgataagtaggttttgtgttttcaacgtagggaaaatgttatcagtgaataggtggtgtactttacttggtataatttaaagttgcacagtaagtactgtttccttattttaatctttctttactcataatgtatttaagaatttgctgttttatttaacgctgctactcttaatcttctctaaatttttccccctactttcttgcttctgtttcacattttttaaaagggcaagtacaggagcaactgctgctacccagaaaaatgtgtgtattataaataattaaagagtttttaattgctttctgtatga

SEQ ID NO: 34669 - DNA, 6541 bp, Homo sapiens
gcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 34670 - DNA, 2667 bp, Homo sapiens
gcacagaagtttgctgcatcactggtgagctggggagtgtcctgtgtggtgtccacttaatcttactaggaaggatcccctcatttcaacaagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttc

SEQ ID NO: 34671 - DNA, 2878 bp, Homo sapiens
ttttctttccattttatttcctagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttattta

SEQ ID NO: 34672 - DNA, 6539 bp, Homo sapiens
gcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 34673 - DNA, 6851 bp, Homo sapiens
agatgaaagggccgcggcgcgacggccgggggagccgagctgagcctgcgacccacaaagccgccgccgccgccgccgtgatggggctgtgaggcgtccgcccgcgttcggtcctcagccggcccgcgactatgcccggccgcgcccgccctccgcgccctcccgccgcaggaccatgaggccgcgctcgggcgggcgcccaggggccacgggccgccgccgccgccgcctgcgccgccgcccccgcggcctccggtgcagccgcctgccgccgccgccgccgctgccgctgctgctcgggctgctgctggcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 34674 - DNA, 1442 bp, Homo sapiens
tcctggtctccatgtcatctgccagaaaggccacctgcgccagcacctcctgagaccggccttcaaagacacgacgcatgccgctctgccgtccggagcacttaatgcctagagccagcagggtcccagtggccgcgtcactgcctctgagccacgcggtcattccaactcaactgccctcgcgtcctggccacaggccccctgggagaccccggagatgcccaaaggcctcatgcctgccgcctccagtgggacctagcagcacacagacagcgaagcgggtgaccatggggtggccacggccgggccgagccctcgtggcagtcaaagccttgctggtcttgtcgctgctccaggtgcccgcgcaggcagtggtacgggccgtgctggaagacaactcgagctcggtggactttgcggatctgccggcgctgttcggcgtccccctggcccccgagggcatacggggctacctgatggaggtcaagccagccaacgcgtgccatcccatcgaggccccgcgactgggcaaccgctctctgggcgccatcgtgctgatccgccgctacgactgcaccttcgacctcaaggtgctgaacgcccagcgcgccggcttcgaggcggccatcgtgcacaacgtccactccgacgacctcgtgagcatgacccacgtctacgaggacttgaggggccagatcgccatcccctcagtgttcgtgagcgaggccgcctcgcaggacctgcgggtcatcctgggctgcaacaagtcggcccacgcgctgctcctgcccgacgacccaccgtgccacgacctgggctgtcaccccgtgctgaccgtgtcctgggtgctgggctgtaccctggccctggtcgtatcagccttctttgtcctgaaccacctgtggctctgggcccaggcctgctgcagccacagacggccggtgaagacgtctacctgccagaaggcccaggtccgcaccttcacgtggcacaacgacctgtgtgccatctgcctggatgagtatgaggagggcgaccaactcaagatcctgccctgctcccacacctaccactgcaaatgcattgacccctggttctcccaagccccccggcgctcctgccccgtgtgcaaacagtcggtggccgccacagaagacagctttgactccaccacctacagcttcagggacgaggacccctccctaccgggccaccggccccccatctgggccattcaagtccagctacgctcccggaggctggagctgctgggccgcgccagtccccactgccactgcagcaccacgtccctggaggcagagtataccactgtctcctcagcccctcctgaggcccctggtcagtaaagatctagggcagggaggggggtgcaatgaggaatgtttctggtctgaaaagaataaagtgggtttgaaagcgga

SEQ ID NO: 34675 - DNA, 1479 bp, Homo sapiens
gaggggtcaggcggtgctggcaagatggctgcacttgagaagatgacgtttcccaagaagatgacatttccagagaaaccaagccacaaaaagtacagggccgccctgaagaaggagaaacgaaagaaacgtcggcaggaacttgctcgactgagagactcaggactctcacaggaggaggaagaggacacttttattgaagaacaacaactagaagaagagaagctattggaaagagagagggaaagattacatgaggagtggttgctgagggagcagaaggcacaagaagaattcagaataaagaaggaaaaggaagaggcggctaaaaaatggctagaagaacaagagagaaagttaaaggaacaatggaaagaacagcagaggaaagagagagaagaggaggagcagaaacaacaggagaagaaagaaaaagaggaagctgtgcagaagatgctggatcaggctgaaaatgatttagaaaatagtaccacatggcaaaacccagaaccacccgtggatttcagagtaatggagaaggatcgagctaattgtcccttctacagtaaaacaggagcttgcagatttggagacagatgttcacgtaaacataatttcccaacatctagtcctacccttcttattaagagcatgtttacaacgtttggaatggagcagtgcaggagggatgactatgaccctgacgcaagcctggagtacagcgaggaagaaacctaccaacagttcctagatttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcaatgtgaattctgcccagtgacccggtggaaaatggcgatttgtggtttatttgaaatacaacaatgtccaagaggaaaacactgcaactttcttcatgtgttcagaaatcccaacaatgaattctgggaagctaatagagacatctacttgtcttcagatcagactggctcctcctttggcaagaactccgagaggagggagaagatgggccaccacgaccactactacagcaggcagcggggaaggagaaaccctagtccagaccacacctacaaaagaaatggggaatccgagagaaaaaagagtagtcatagggggaagaaatctcacaaacgcacatcaaagagtcgggagaggcacaattcaccaagcagaggaagaaataggcaccgcagctgggaccagggccgccggagccagagccgcaggagccaccgcagccggagccaaagttcctctaggtgccgaagtcgtgggaggaggaagtcgggtaatagagacagaactgttcagagtccccaatccaaataaactagttttgttctt

SEQ ID NO: 34676 - DNA, 1491 bp, Homo sapiens
gaggggcggggcggtgccggcaagatggctgcgcccgagaagatgacgtttcccgagaaaccaagccacaaaaagtacagggccgccctgaagaaggagaaacgaaagaaacgtcggcaggaacttgctcgactgagagactcaggactctcacagaaggaggaagaggaggacacttttattgaagaacaacaactagaagaagagaagctattggaaagagagaggcaaagattacatgaggagtggttgctaagagagcagaaggcacaagaagaattcagaataaagaaggaaaaggaagaggcggctaaaaaacggcaagaagaacaagagagaaagttaaaggaacaatgggaagaacagcagaggaaagagagagaagaggaggagcagaaacgacaggagaagaaagaaaaagaggaagctttgcagaagatgctggatcaggctgaaaatgagttggaaaatggtaccacatggcaaaacccagaaccacccgtggatttcagagtaatggagaaggatcgagctaattgtcccttctacagtaaaacaggagcttgcagatttggagatagatgttcacgtaaacataatttcccaacatccagtcctacccttcttattaagagcatgtttacgacgtttggaatggagcagtgcaggagggatgactatgaccctgacgcaagcctggagtacagcgaggaagaaacctaccaacagttcctagacttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcagtgtgaattctgccccgtgacccggtggaaaatggcgatttgtggtttatttgaaatacaacaatgtccaagaggaaagcactgcaactttcttcatgtgttcagaaatcccaacaatgaattctgggaagctaatagagacatctacttgtctccagatcggactggctcctcctttgggaagaactccgaaaggagggagaggatgggccaccacgacgactactacagcaggctgcggggaaggagaaaccctagtccagaccactcctacaaaagaaatggggaatccgagaggaaaagtagtcgtcacagggggaagaaatctcacaaacgcacatcaaagagtcgggagaggcacaattcacgaagcagaggaagaaatagggaccgcagcagggaccgcagccggggccggggcagccggagccggagccggagccggagccgcaggagccgccgcagccggagccaaagttcctctaggtcccgaagtcgtggcaggaggaggtcgggtaatagagacagaactgttcagagtcccaaatccaaataaactagttttgttcttaaa

SEQ ID NO: 34677 - DNA, 744 bp, Homo sapiens
gaggggcggggcggtgccggcaagatggctgcgcccgagaagatgacgtttcccgagaaaccaagccacaaaaagtacagggccgccctgaagaaggagaaacgaaagaaacgtcggcaggaacttgctcgactgagagactcaggactctcacagaaggaggaagaggaggacacttttattgaagaacaacaactagaagaagagaagctattggaaagagagaggctggagtgcagtggtgtgatctccgctcaccgcaacctccacctcccaggttcacacgattctcctgcctcagcctcccgagtagccgggattacaggcacgcaccgccacacccagttaatttttttttgtacttttagtagagatggggtttcaccatgttggccaggatggtctcgatctcttgacctcatgatctgcccgcctcggcctcacaaagtgctgagattacaggtgtgagccaccgcgctcagccgaaatttcttaatgtctctaagcttctatttccttgtctgtaatatggagataaagtcaatcacagtatccacctcacagaattgtgaagattaaaggaggtgatggatgtatagtgtttaacacagtgtcagcagatgagaggtgctgtgatagctctagttcttattattatagatttctgttatgatgaagacaatagatacggtatgaaataagagagtaatttttttcctgtttatttgaaatgcttcttttaaa

SEQ ID NO: 34678 - DNA, 4273 bp, Homo sapiens
gtgcaggagtctgagaagaaagggtgtagatggagaggcggtggcctcacctctgcatgctccgtgggaagcggcggaggcgcccagcatccctcctactctgcccttggtggaggtttacgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtctgaa

SEQ ID NO: 34679 - DNA, 3734 bp, Homo sapiens
aaagcgaagcgtcagcagggcgccccgccccctcggtcggcacgggagggggcccggaagagcccgaggcttttttttcctccgcggtggggcgttgccatggagacgcgggcggcagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccg

SEQ ID NO: 34680 - DNA, 4756 bp, Homo sapiens
agactccatccgccatgttggatgccgcagattcgccataacctcgccggctcttttcttaaaaaaataaaaataaaaagcgaagcgtcagcagggcgccccgccccctcggtcggcacgggagggggcccggaagagcccgaggcttttttttcctccgcggtggggcgttgccatggagacgcgggcggcaggtctgctggagtttgctggaggtccgctccataccctgtttgcctgggtatcaccagtggaggctgcagaacaacaaagattgctgcctgttcctgcctctggaagcttcgtcccagaggggcacctgccagatgccagccagagctctcctgtatgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtc

SEQ ID NO: 34681 - DNA, 1728 bp, Homo sapiens
atggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatg

SEQ ID NO: 34682 - DNA, 2523 bp, Homo sapiens
gggctcggccgccagcactaaagatggagaggcgccggggccttgcaggggagggggctcggcgttgacgtgggacgcggcggaggcgcagcagccggtggtgatttgctaacctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaagaaaaaaaaaaacagaaggaaaaggaaa

SEQ ID NO: 34683 - DNA, 2287 bp, Homo sapiens
agcgctgcgggccctcctcggctctcggcgggaccggcggtgacaccggagctcgccgtgcgctcccggccgctctcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaagaaa

SEQ ID NO: 34684 - DNA, 572 bp, Homo sapiens
tcttatgtatgcggaccggtgcgcgggcgcaagataagcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgc

SEQ ID NO: 34685 - DNA, 773 bp, Homo sapiens
agcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcgttctcagaaaccccgatgtctgcgggaaagcacgcggtggctcggctcggctgaatgctcatcccaaccttgacggcctccgtccccaccccggggcgggcagcaaaaatgtcttgaccagccgtcctgtgaatcctttctgcgtgagcttggtggctcctgaactgatagagctccttctgggggtggagcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggagg

SEQ ID NO: 34686 - DNA, 2661 bp, Homo sapiens
atgcgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttct

SEQ ID NO: 34687 - DNA, 2770 bp, Homo sapiens
atgcgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacaggccctgcgactctgcccgcagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttct

SEQ ID NO: 34688 - DNA, 2745 bp, Homo sapiens
cggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 34689 - DNA, 731 bp, Homo sapiens
gtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacaggccctgcgactctgcccgcagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaa

SEQ ID NO: 34690 - DNA, 722 bp, Homo sapiens
gagaagccctaccagtgcgactactgcggccgctccttctccgaccccacttccaagatgcgccacctggagacccacgacacggacaaggagcacaagtgcccacactgcgacaagaagttcaaccagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtggga

SEQ ID NO: 34691 - DNA, 2506 bp, Homo sapiens
atgcgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccccaggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttct

SEQ ID NO: 34692 - DNA, 1851 bp, Homo sapiens
gcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtgtgcggacccctcccggaaccagcgcctggcagccgccggtggccgcagccgcatgcatgccacgtggtggggcgggcggggagcacagccccggcctccaggagctcatcagcttgttcacccaggaaacaggcgcagcgagagccacttccgcgggggagctcccggttgctctgcggagggcaggccgactcagggcggggtttggtcctgaaaaaatggggtggggcggcttacctctcaccgctgggacctgggacctctcctgacccaggagagatagagcccttcacggaccctggcaagcctgagagtcaattgttcctttgtgggaggggcaggtgagggggcccggggccgagctctgtggggtggcccccctgacccctccctgggcacaggtagggaacctgaaggcccacctgaagatccacatcgctgacgggcccctcaagtgccgagagtgtggg

SEQ ID NO: 34693 - DNA, 2511 bp, Homo sapiens
aacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggtctgccctgttccatctccaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttct

SEQ ID NO: 34694 - DNA, 2956 bp, Homo sapiens
ggggcggggggaagtttaggagttgaggaaagaagattaaagagcgcgaggagacaaataaaaagaagtgttaagaattgcctttgggactctgaaggctgaagaattgatgaattgcaagtttgtgccccatagctgcacagactgcctgaagttacatttagagactgaaatcactgcaccttaaaaacaaaagattgagctgcactgtattcctaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaa

SEQ ID NO: 34695 - DNA, 3323 bp, Homo sapiens
acttgttgcttacggtacagtccagcatgagctggaaatgtaggaacctcagcctcccgagcagaaagaatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaaatttccacttgtgaagagcactacaaaaaatatataacaaaatctaaaaggcctactgtctttaagtacaccgcttgcagtgtttcagtggacattttcacaattctggccgcttggacttcacagtaaccagttaaaactgtggaatatcacttctggttgaaaacccagaggaaaggccctgctgttttccacctaccacgttgtctgatttcataaaagggctgtgggggtgggaagggcagtgggttcggtggtgtgggaaagaaagacgaatggcaggcttcttccccagattctgcccgggtccacacaccctggcccaccttctccatatccccctcttgcagcagaagccaggaagacttggacaagcaacaagcaacagtggctatcgtatttattcagtgtcttcgctgagccacagcctcagcacaatcaagagggactttcatgaaaggcaggaatgcagataaaacaaagatatcagaaatttgcacctatgtttctaggtacaagagaaggattatttccaacaatctttgc

SEQ ID NO: 34696 - DNA, 3740 bp, Homo sapiens
ggaattttatctctgctcacagtctacattacaacattagttcattctgggcactttagcttccttgaatctccagttgatctcacacccatgcctatgatattcttctcctggttaatcaagaattctctatttctgctccgtcatccatgccactacaaataaaaagaagtgttaagaattgcctttgggactctgaaggctgaagaattgatgaattgcaagtttgtgccccatagctgcacagcctatgtctaagcacagctcatcttcacaaactgaagtggatcttgatttctggaaatgtccaaataatgacaacaaccccatggaggtggatacatcagagtcagctggaggtggtcagaattatttgcaatgtttgggaaagcacctaccaaggcttcctattacctatttcacagaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaaatttccacttgtgaagagcactacaaaaaatatataacaaaatctaaaaggcctactgtctttaagtacaccgcttgcagtgtttcagtggacattttcacaattctggccgcttggacttcacagtaaccagttaaaactgtggaatatcacttctggttgaaaacccagaggaaaggccctgctgttttccacctaccacgttgtctgatttcataaaagggctgtgggggtgggaagggcagtgggttcggtggtgtgggaaagaaagacgaatggcaggcttcttccccagattctgcccgggtccacacaccctggcccaccttctccatatccccctcttgcagcagaagccaggaagacttggacaagcaacaagcaacagtggctatcgtatttattcagtgtcttcgctgagccacagcctcagcacaatcaagagggactttcatgaaaggcaggaatgcagataaaacaaagatatcagaaatttgcacctatgtttctaggtacaagagaaggattatttccaacaatctttgcaaaaaaaaaaaaa

SEQ ID NO: 34697 - DNA, 2816 bp, Homo sapiens
acatttcaaaaaaaatacatagactgatgtttcagacttgtgcagcataagcctacagggtacgaagaatgaactctgagaatgtttggagaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaa

SEQ ID NO: 34698 - DNA, 587 bp, Homo sapiens
aaggtttttcaaagaggcagtggaggaggttctaataaatttggaaggaaacagttccctgtcttgggaaaaggagaactcctgactgattagcattcacaccagatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccagga

SEQ ID NO: 34699 - DNA, 3133 bp, Homo sapiens
atctagcctcccagcctcactgcattatttgtgaaaatggccagtgtgaggaattattaattaaagctaacaaatcaccctgacaagctgtgccctggcatggctgaaggttgattggcgaaagtcttctcctttggagaaaagactttttgtgctcgtgacgcagtcagggacggattattgaatatgcaagttagaagaaaaatcacaggacaagcaaattgagtatttactggcaaataattgcactcttaagctgtggctctcttcctaaattcttaacattctcgagggttagaaagaaacacagaaaaatgcatcggtacagagtacatttcaaaaaaaatacatagactgatgtttcagacttgtgcagaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaaa

SEQ ID NO: 34700 - DNA, 2757 bp, Homo sapiens
ttgggaaacagcccagtggtataaggatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaa

SEQ ID NO: 34701 - DNA, 2800 bp, Homo sapiens
gcagggagcttaacagccaggcctggacaccctcaagagactgtgtgctgattctcagtcgtcactccttggatcaggaaccatagtcctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaaa

SEQ ID NO: 34702 - DNA, 551 bp, Homo sapiens
actcagaagagacacagacaggagagaggaggaggggtggggggagagagagagaatcaatatcaagaatagaaggagctccgaagccattttttttttaaagaagtatcgggacttgggagagggtgacaaagaaggtttttcaaagaggcagtggaggaggttctaataaatttggaaggaaacagttccctgtcttgggaaaaggagaactcctgactgattagcattcacaccagatgcagccgctctctgctccctgccccaatgaacatctgcactaggcccaagccttggagtaatttacctgaagagtgacaccattgattttgaaactactatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggaagaaacccaagacagctgaaaaccagaaggcatctgaggagaatg

SEQ ID NO: 34703 - DNA, 5519 bp, Homo sapiens
cgcgcttccgggttggctgtggctgtggctgcggcggcggcgcaggagcagaaaccggtgcggcgcagaagccccagaggcgggcggggcggagcggagggccagcgggccccggcgtgggtctcccgccaggccgccggatttaacccttagtggcttctgaagaaaatggcagaaacatcgccagagccttctgggcagcttgttgtacactcagacgctcacagtgacactgtgctggccagttttgaggatcagaggaagaaaggcttcctctgtgacattactttaatcgtggagaatgtacatttccgggcccacaaagccttacttgctgccagtagtgaatacttctcaatgatgtttgcagaagagggggaaatcggccaatccatttatatgctggaaggcatggttgcagacacctttggtatcctgctggaatttatctacacaggttatctccatgccagtgagaaaagtacagaacaaatcctggctactgctcagttcttaaaagtctatgacctggtaaaggcttacacagacttccaaaataatcatagctccccaaagccaacaactttgaacactgctggtgccccagtggttgttatctctaataagaaaaacgatcctccaaagcggaaacggggaagaccaaaaaaagtcaatacattgcaggaggagaaatcagaactggctgcagaggaagaaatacagttaagagtgaacaattcagttcagaatagacaaaactttgtggttaaaggagacagtggtgtactgaatgagcaaattgcagcaaaagaaaaggaagaatcggagcctacttgtgagccaagtagagaggaggaaatgccagttgaaaaagatgagaactatgatcccaagaccgaggatggccaggcaagccagagtcgatacagcaagcggaggatttggagatccgtcaaacttaaagattacaaacttgttggggatcaagaggaccatggttcagccaagaggatctgtggaaggagaaagcgccctggaggccctgaggcccgctgtaaagactgtggcaaggtctttaagtacaatcactttttagcaatccaccagaggagccacacaggggagcgacctttcaaatgtaatgagtgtggaaaaggctttgcccagaagcactcgctacaggtccacaccaggatgcacacaggcgagcggccgtacacctgcaccgtgtgcagcaaggctctgaccaccaagcactcactgctggagcacatgagcctgcactcaggacagaagtcttttacctgtgatcaatgcggaaaatatttcagccagaacagacagctaaagagccattaccgagttcatacaggccactcattaccggaatgcaaagactgccatcgcaaattcatggatgtgtctcagctaaagaaacatctgcgaacacacacaggtgagaagccatttacttgtgaaatctgtggcaaatctttcacagcaaagagttctcttcagacccacatcagaatccatcgaggagaaaagccatactcctgtggcatttgtggcaaatccttctctgactccagtgccaaaaggagacactgcattctacacactggcaagaagcctttctcctgccctgagtgtaacttacagtttgctcgcttagacaacttgaaggctcacttgaaaattcatagcaaggagaagcatgcttcagatgccagcagcatttctggcagtagtaatacagaagaggtcaggaatattcttcagctacagccatatcaactctctacctcgggagagcaggaaattcagcttctcgtaaccgattctgtacataacatcaatttcatgcccggtcctagccagggaatcagcattgtgactgcagagagttcccaaaacatgactgcagaccaggctgctaatcttaccctgctcacgcagcagccagagcaactgcagaatttaattctttcagctcaacaggagcaaacagaacacattcagagcctcaatatgattgaaagccagatggggccctcacaaacagagccagtgcacgtgatcactctgtccaaggaaacactggaacatcttcatgcccatcaagagcaaacagaggagctccatttagctacaagtacttcagatccagctcagcacctgcagctgacacaggagcctggtccgccaccacccactcaccacgtgccccagccaacgccacttggccaggagcagagctgacctgtaaacacgtttgactgcttgattgggctcttcttataagccagctctgactggattttgaacgcttgaaatcaggctctccacaccattgacttgcagatgcttctgtgagagctgtgatggctaactgatgtttataatgccctccatccaggtagcaagatgtgtgtatgtcttgtctaaggtactgatttgtattgagcatttcaatattattgaatggttttcattttaatctgcaatgtctcataaagactcgggtagtttttctttgggggcattgatctcagtttttctgtaaggtttaaatgttcacagccataggttatggtcttgccaacctccccagttatgtttttttgttttctaggacaaagggagtcattttggttgaactgggcagaatggtttgttctattttcttatttttcttaggcaacacagttgttaccacaagacaagtcagggctaaatatgacagatcacaatgtatggggaatttgcccttttaataatttccagtcccctaagacaaagtaaccctcaacgttttatctttatgcagtacagtgggcttattgtgttaacacttcagaaagattcaaactcataaactcagtattttaactcaaaattcatgtaacaagatagccaaaagcataggatttcttaaaattctgaattcgtcttttctgagaaacataaatttacatatttttcaacagaaggctatcaaaattttaattaagtttaaaatacaaaattggatcaagacattcaccctaaattctgaatttttgtcagaaaagagatttgattttcatgaaggtaaagctttcttcactattctggaacataaaactttattcagtgtaatttaagtcttatatatactctactgaattctaactgatctcctgaaaatgttgatctacgtgttgtgtctgataactttctggagatggaagcttataattcatttttattgcagactagttaaatcccacaaagtgaatatcttctcctaatctttccttttttagagacagggtctcactgtatcacccaggccagagtgtagtggcacaatcattgctcactgtaacctcgaattcctgggctcaagcaaccctcccaccttagcctccctagtagctgggactacagggatgtaccaccacacccagctaatcttcatctaatcttaaaactttgagcctcagagactttgtagccagcatgtgtctgtaattgtatgatttttaaatcatcatcaaaagattaaattatgtttgggttaggttttcaagctaagcttattgaattcttttaccactttcatgtaagctggtaggggatttttgagaaaagaaggtgggcactagtatatctaaattaacaatgctgatggggagtagggggtaatctactctaaaattaatagagcctttccatcaattgttttgttttagacatccttgatttctccctaaatcaaataagttatttggaggttagagtaatagagaattcttcaggtttgagagaagataaaaacattttggttgcatatttgctaagctatattttattatatgtaattcacaaaacttccaaaatgatatatatcttatatgtatcaaccaaactaatgttaaatcaggcctgactagagcaaagataacaattttttacaaacactgttaagccctaagtattatttcaggttctcgtttaaactgtttaattttattcttaaaacacaaagtttttaccaacttttcaaagcccaccaatccacattttctccaggaaattaaatatttaagtaagtgagtgtttactcactctggatagctaggtgattattcagaaaatacggttacatagctatttataagtcaagtttcactggctctataacagtctacctctacactaagagaactataacatgaacaacataggtcactttaaatgttctagtagcaacttttaaaaacataaaaagaagcaggtgaaaatgttaataaaagtttatttaatccaacatttgccaaatatttcaacatataaaaatatattagtgagacattttacattctctttttcatactaagctttcgaaatctggtgtgtattttacactttctgcacatctccatttggatgctaatgttcattggacatacttgatctgtatttagatttcatacaacttacagttgaaaacagattctcatatcaagtagctaagacaaaagtttttttcaagaattgaaataagtatcagtttaaaaatttatattaaatttattaaaattaaaatccagttccttgttgcatgggacacagtgcaaatgcttgataagcacatgtggctagtggctgctatattggacagcatgggccacctgtttctaacttgagcatcagtcctagctatgcctgaattatttgaccagctgtcaaagagaaacaaggaaatgatagctttgttaatctagcctctttctttgtcccacatatacattctacccctttgaataaaaaagttcaatgacgccgggcgtggaggctcatgcctgtaatcccagcactttgggaggccaaggtgggcggatcacgaggtcaggagttcgagggcagcctgaccaacatagtgaaaccccatctctactaaaaatacaaaaattagctgggcgtggtggtgtacccctgtaatcccagctactcgggaggctgagacaggagaatcacttgaacccaggaggcggaggctgcagtgagctgagatcacgccattgcactcaagcctggcgacagagcgagactccgtctcaaaaaaaaaagttaaatgacttgagtacccaaaagaaatgtcgtgaacatgaaagtacttctcatgtgtccttgagaaatgatgttgctagtgcagtgtttcacaattcattttctactaaatgtgtaccattttttaaattgttttaacagaaatatagagtgtgtttcttaggaaatagaatgttatgctttggggctcctgaaacacctcgttttgaaggtgaatctttggttttctcccagaagagggtctgccttgggatgattggagctcttaccatcaaaatcagttattcaagtgcttgcccagtgcttcttgaaactcacctctactctgtattttctacagttggttcttgtgttataaatgttgtgagcaacagattaaatgatgctgaggaatgaaaaaa

SEQ ID NO: 34704 - DNA, 1586 bp, Homo sapiens
ggcgcccctctttcccctgctaccagacacgcggtcacgtggggccatcgcgggctgccggcgcgggaagccgcgcgagaggcggccgaggggtgcgtgagccggcgccactgcttgcagtgcgcggcttgggagcccgcccctcctgcacggaggagtcggcctgccgccgcggcggcatctggaaccacaatggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaagtgaatgcataaaaatacaaccaactgacatccaacctgacatattcagctatttgttgcacattatgtacacggggaaagggccaaaacagattgtggatcatagtcgtttggaggaagggattcgatttcttcacgccgactacctttctcacattgcaactgaaatgaatcaagtgttctcaccagagactgtgcagtcctcaaatttatatggcattcagatctcaacaacccaaaaaacagttgtcaaacaaggactggaggtcaaagaagctccttccagtaacagtggaaacagagctgctgtccagggtgaccacccccagttgcagttgtctcttgctattggtctggatgatggcactgcagaccagcagagggcctgtcctgccacccaggccctggaggagcaccagaagcccccagtttccatcaagcaggagagatgtgacccagaatctgtgatctcccagagccacccctcaccctcatcagaggtgacaggccccacttttactgaaaacagtgtcaaaatacacttatgccattactgtggggaacgttttgattcccgtagtaacctaaggcaacatctccatacacatgtgtctggatccctgccattcggtgtccctgcttccattctggaaagtaatgaccttggtgaagtgcatccccttaatgaaaacagcgaggcccttgaatgccgcaggctcagctccttcattgttaaggagaatgaacagcagccagaccacaccaaccggggtaccacagagcctttgcagatcagtcaagtatctttgatctccaaagacacagagccagtagaattaaactgtaatttttctttttcaaggaaaagaaaaatgagctgtaccatctgtggtcataaattccctcgaaagagccaattgttggaacacatgtatacacacaaaggtaaatcttacagatataaccgatgccaaaggtttggtaatgcattggcccagagatttcagccatactgtgacagctggtctgatgtctccctgaaaagttctcgcttgtcacaagaacacttagacttgccttgtgccttagagtcagagctcacacaagaaaatgtggatactatcctagttgagtagcagcttctctttcagaatttttataccaattctgaaaaagaaaatttgcgtggcatttttaattcataaattattttcctcctcaa

SEQ ID NO: 34705 - DNA, 2094 bp, Homo sapiens
aagtttctgcgtcgagctccgaggaggctggcgcaacccgcaccgcgggggccgtcgcggcggcggcggcttgaccacccctcttgcccctctcaaggcttgacccatcttatcaccgtcttctctggcactcagtatttggagtaatcagttgttaccagttgcggaggcagcgcatagcacaacgtagtacctggaacctgacggcacctagcatgtttcaacagttagcgcccgcatcaccccaagggattaaatttggcattctttctcttgagactcaagtcctggcagagctgttgatcctctcacaagattctgtcatagaagacaccaggcctgaagagcgtgatgtagctggagctagctacacctcttgatagctaagactccaaggctccagacaccttggtgattgcactctccaccatgccaggaccgcagtgccagtttaccccactcacctgtagagaatgtatccggcggaggtcattatatatacttggcttgattcaggttatggagaagtcaggcatggccactgtgtgggtttgatggtatttctaggtgagatggagtttcactcttgttgcccagactggagtgcaatgacacaatctcagctcaccacaacctctgcctcctgggttcaagcgattctcccgcctcagcctcccgagtagccgggattatagaaccacaatggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaagtgaatgcataaaaatacaaccaactgacatccaacctgacatattcagctatttgttgcacattatgtacacggggaaagggccaaaacagattgtggatcatagtcgtttggaggaagggattcgatttcttcacgccgactacctttctcacattgcaactgaaatgaatcaagtgttctcaccagagactgtgcagtcctcaaatttatatggcattcagatctcaacaacccaaaaaacagttgtcaaacaaggactggaggtcaaagaagctccttccagtaacagtggaaacagagctgctgtccagggtgaccacccccagttgcagttgtctcttgctattggtctggatgatggcactgcagaccagcagagggcctgtcctgccacccaggccctggaggagcaccagaagcccccagtttccatcaagcaggagagatgtgacccagaatctgtgatctcccagagccacccctcaccctcatcagaggtgacaggccccacttttactgaaaacagtgtcaaaatacacttatgccattactgtggggaacgttttgattcccgtagtaacctaaggcaacatctccatacacatgtgtctggatccctgccattcggtgtccctgcttccattctggaaagtaatgaccttggtgaagtgcatccccttaatgaaaacagcgaggcccttgaatgccgcaggctcagctccttcattgttaaggagaatgaacagcagccagaccacaccaaccggggtaccacagagcctttgcagatcagtcaagtatctttgatctccaaagacacagagccagtagaattaaactgtaatttttctttttcaaggaaaagaaaaatgagctgtaccatctgtggtcataaattccctcgaaagagccaattgttggaacacatgtatacacacaaaggtaaatcttacagatataaccgatgccaaaggtttggtaatgcattggcccagagatttcagccatactgtgacagctggtctgatgtctccctgaaaagttctcgcttgtcacaagaacacttagacttgccttgtgccttagagtcagagctcacacaagaaaatgtggatactatcctagttgagtagcagcttctctttcagaatttttataccaattctgaaaaagaaaatttgcgtggcatttttaattcataaattattttcctcctc

SEQ ID NO: 34706 - DNA, 1960 bp, Homo sapiens
gccgtcatctctaagaaacaaccataccactgaatgctactgtgtacttacaaaccacactcatattcgtcacgtcatttcatcttcacccccacctccaaatgaggcttgaaatgagatgagatgttcctccctcccctttcaaccatggacctcacactgtggacttcctcttagagcctctgagttaggtacccaagccaaggcacaatgtccctgccccccataagactgcccagcccctatggctctgatcggctggtacagctagcagccaggctccggccagcactctgtgatactctgatcaccgtagggagccaggagttccccgcccacagcctggtgctagcaggtgtcagccagcagctgggccgcaggggccagtgggctctgggagaaggcatcagcccttctacctttgcccagctcctgaactttgtgtatggggagagtgtagagctgcagcctggagagctaaggccccttcaggaggcggccagggccttgggagtgcagtccctggaagaggcatgctggagggctcgaggggacagggctaaaaagccagatccaggcctgaagaaacatcaggaggagccagagaaaccctcaaggaatcctgagagagaactgggggaccctggagagaagcagaaaccagaacaggtttctagaactggtgggagagaacaggagatgttgcacaagcactcgccaccaagaggcagacccgagatggcaggagcaacgcaggaggctcagcaggaacagaccaggtcaaaggagaaacgcctccaagcccctgttggccaaaggggagcagatgggaagcatggagtgctcacgtggttgagggaaaatccagggggctctgaggaaagtctgcgcaagctccctggcccccttcccccagcaggctccctgcaaaccagcgtcacccctaggccctcgtgggctgaggccccttggttggtggggggccagcctgccctgtggagcatcctgctgatgccgcccagatatggcattcccttctaccatagcacccccaccactggagcctggcaggaggtctggcgggaacagaggatcccactgtccctaaatgcccccaaagggctctggagccagaaccagttggcctcctccagccctaccccaggttccctcccccagggccccgcacagctcagccctggggagatggaagagtctgatcaggggcacacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggagagaagcccttctcctgtagcctttgtcctcagcgctcccgggacttctcggccatgaccaagcacctgcggacacacggggccgctccgtaccgctgctccctgtgcggggccggctgtcccagcctggcctccatgcaggcgcacatgcgcggtcactcgcccagccaactcccgcccggatggaccatccgctccaccttcctctactcctcctcgaggccgtctcggccctcgacctctccctgttgtccttcttcctccaccacctgacggggtgtcggtagcgtcttagccaagagtccaattaaagaacgaaaagcgggccggctcggcttctgacctggcaccgctgctacggcggcctagcaaattccgccccagaagcgccccaggaagggcgccgagtgccctctcctggacgatcgcgggtcgcagaagcccaggccagcgagccctacagagtgaggacactgaagtgtgcaggagcgaaggttaacagtaggggagattgtcgatctcatcaccataataaagagtttcctgtgccctcccttca

SEQ ID NO: 34707 - DNA, 1464 bp, Homo sapiens
atgtccctgccccccataagactgcccagcccctatggctctgatcggctggtacagctagcagccaggctccggccagcactctgtgatactctgatcaccgtagggagccaggagttccccgcccacagcctggtgctagcaggtgtcagccagcagctgggccgcaggggccagtgggctctgggagaaggcatcagcccttctacctttgcccagctcctgaactttgtgtatggggagagtgtagagctgcagcctggagagctaaggccccttcaggaggcggccagggccttgggagtgcagtccctggaagaggcatgctggagggctcgaggggacagggctaaaaagccagatccaggcctgaagaaacatcaggaggagccagagaaaccctcaaggaatcctgagagagaactgggggaccctggagagaagcagaaaccagaacaggtttctagaactggtgggagagaacaggagatgttgcacaagcactcgccaccaagaggcagacccgagatggcaggagcaacgcaggaggctcagcaggaacagaccaggtcaaaggagaaacgcctccaagcccctgttggccaaaggggagcagatgggaagcatggagtgctcacgtggttgagggaaaatccagggggctctgaggaaagtctgcgcaagctccctggcccccttcccccagcaggctccctgcaaaccagcgtcacccctaggccctcgtgggctgaggccccttggttggtggggggccagcctgccctgtggagcatcctgctgatgccgcccagatatggcattcccttctaccatagcacccccaccactggagcctggcaggaggtctggcgggaacagaggatcccactgtccctaaatgcccccaaagggctctggagccagaaccagttggcctcctccagccctaccccaggttccctcccccagggccccgcacagctcagccctggggagatggaagagtctgatcaggggcacacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggagagaagcccttctcctgtagcctttgtcctcagcgctcccgggacttctcggccatgaccaagcacctgcggacacacggggccgctccgtaccgctgctccctgtgcggggccggctgtcccagcctggcctccatgcaggcgcacatgcgcggtcactcgcccagccaactcccgcccggatggaccatccgctccaccttcctctactcctcctcgaggccgtctcggccctcgacctctccctgttgtccttcttcctccaccacctga

SEQ ID NO: 34708 - DNA, 5211 bp, Homo sapiens
gcctttggcttcagcgcttcgcccccgcgctgtgccctctgtcggcggcgtggggcagctgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcaggcatggagagtagaaaactgatttctgctacagacattcagtactctggcagtctgctgaactccttgaatgagcaacgtggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaataccagttttgatggatcattaatacagaagatgcagattcctacacttcttcaagaaccactttccaattccttaaaaatttcagatataattactagaaatactaatgatccaggcgtaggatcaaaacatctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaaactcctttgaaatactagaaagttttgttttggatgatggggcaggggtttcagaagatctgtaaaacaaattaaggtgcgaacaagttaatttgatctgccacattatctgaaggaagtgtagtgggatttttgttgataatttttagaagcaaattttcctgaaagttttgagtagaggtgagaccccctccccaagtatctgtttatatagttagttttcagctcatttaaaagaggcaaaaattaaaagcttggagagatagtttcctgaatagaatttgaagcagtctgaatgttctttgaaaataactggagttattagcataccctagtacatcttacagctttccccttccatgttagcactttactgctgaattctcaattttcttaacattgagacaataaatgtgtgttttgtcttgtatatggcataaagagtaaataagttttagagttgttctggaaaatgtcagaataagtcagtacttgggttgtgtaatctgctagtccaagcgaacagcaacctcctgctaccctccctctatgaaaatagccatgcagacaagtctctcatctgaagaacaaattagatttagctaattagaattaatcctggctttcattgccatagtctgtaaaagactttggtggctagaccactttataccttcgcagtgtggtctctgggggcaaaaaactaatgaaaacaatctctgtaatggcagataggaggagatgaaaagttctgttgcatggatttttaattctctggctaccacatagtagagaatggaatgaagatttccttttggcttcttaaggttaaaaatattcccatgaacatgaaaattttcaaattttgaatctgaaagccaccaaatgtatctttatgtataaatccttgtaaatgatagattccatgggtgagactttacatattttgggtgggaggctactggcatatatttttaaatgttcatattgcgtagaatctccactaggaagtctttatttgaaatagttgaatcagtgatctagtattttcctttcggcaagatttgttaggtttttaccccttctaaaataagttttattccatctgcaaattgctgcaatattatagtaatcagaaactacataaggaatgttatataggcttgtcagttcccatttttcttgacaacaataaataccacttttaaaaatgacacatatttaaacacttagaaaataaagttaacacttactgaagtgctagtactaaactgtgctagtactaaaagaaaacaggttggaacatacatatagcctagcatttataacagaattgttgaacgtctgtaaatgattttttttttttttgcaaaggaaaaaattgatactggaaaagattgttgtgcatagttattagtcatttgtaaccttgcttaagtatttcttagtccaacatagatattttctttctcctgaccatgtattttaaaatatagtctatttcttgactttgaacttaaagctttaatcataatttctcatgtatacatcgttcttctgatggtaagctggatttgaaggtagtggtttcagtgtttcttaagttggtagctgagggtatcaggcatcagttcatgcaataatacaagaaaaaaaatcctttgcttgccaagaggtagagtgatgtgcatttatctgttttctgttctgtaagtctagaccttcaaaccatttgtaaactaacccctgggaaatttgaaattacctgataacttaagactctgtgatctctggaatcaccatatgtttcttttttgtgtagatattaataacattactctttgactatagtgtgcactctgaaatgtactcagtgaaaatttgttttgagtttcattaatgctatttcaccagttagacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaattctgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaagttcagaattcatgtgaaatacttctttggggcaaaagtccttcattcctggtatttattggattggaaatctgtagcaagatgctgtttaaaattaccatattgtttttttatcttatacttagctctctggctattgaacttccttttcttgtttgaagttagcttcaaatttgctcctatgctaaattacctgtaaatattctggataggaactacttgaaatagtaatttgttaaaagatatgacaaaatgaaaatgcttaaactacagaaatttaaaaatgccataacaatcttgcgagactaactttaaaatatactttaaatgattattatgattttggtggtaacgatcccccacacacaaccactatgaagaaataatgccgcatttttcccccattgtaccaaaaagataaaaaaatggtaaacactgatcaaggtattttgtattgtcaaggcatgcatattctaaagaattaaatgctaacttaacagcactggctttctggctggtcaactatatgaaaccttgttcattcctccgagtactgtaatgttcacacttgtacaatcttccctgtcatgactttaagttctacttttcattaaccatggcctgatattagttcttagagcttcttgtggcaaaaataaaatgatttaattctga

SEQ ID NO: 34709 - DNA, 5308 bp, Homo sapiens
tttggcttcagcgcttcgcccccgcgctgtgccctctgtcggcggcgtggggcagctgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcagtgtctgttgacttcacttggcactgtttaacattccacctctggaaattgtaaagatggagagatgaggggaagggacaaggggatgaagaaagaggaaagggcatggagagtagaaaactgatttctgctacagacattcagtactctggcagtctgctgaactccttgaatgagcaacgtggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaataccagttttgatggatcattaatacagaagatgcagattcctacacttcttcaagaaccactttccaattccttaaaaatttcagatataattactagaaatactaatgatccaggcgtaggatcaaaacatctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaaactcctttgaaatactagaaagttttgttttggatgatggggcaggggtttcagaagatctgtaaaacaaattaaggtgcgaacaagttaatttgatctgccacattatctgaaggaagtgtagtgggatttttgttgataatttttagaagcaaattttcctgaaagttttgagtagaggtgagaccccctccccaagtatctgtttatatagttagttttcagctcatttaaaagaggcaaaaattaaaagcttggagagatagtttcctgaatagaatttgaagcagtctgaatgttctttgaaaataactggagttattagcataccctagtacatcttacagctttccccttccatgttagcactttactgctgaattctcaattttcttaacattgagacaataaatgtgtgttttgtcttgtatatggcataaagagtaaataagttttagagttgttctggaaaatgtcagaataagtcagtacttgggttgtgtaatctgctagtccaagcgaacagcaacctcctgctaccctccctctatgaaaatagccatgcagacaagtctctcatctgaagaacaaattagatttagctaattagaattaatcctggctttcattgccatagtctgtaaaagactttggtggctagaccactttataccttcgcagtgtggtctctgggggcaaaaaactaatgaaaacaatctctgtaatggcagataggaggagatgaaaagttctgttgcatggatttttaattctctggctaccacatagtagagaatggaatgaagatttccttttggcttcttaaggttaaaaatattcccatgaacatgaaaattttcaaattttgaatctgaaagccaccaaatgtatctttatgtataaatccttgtaaatgatagattccatgggtgagactttacatattttgggtgggaggctactggcatatatttttaaatgttcatattgcgtagaatctccactaggaagtctttatttgaaatagttgaatcagtgatctagtattttcctttcggcaagatttgttaggtttttaccccttctaaaataagttttattccatctgcaaattgctgcaatattatagtaatcagaaactacataaggaatgttatataggcttgtcagttcccatttttcttgacaacaataaataccacttttaaaaatgacacatatttaaacacttagaaaataaagttaacacttactgaagtgctagtactaaactgtgctagtactaaaagaaaacaggttggaacatacatatagcctagcatttataacagaattgttgaacgtctgtaaatgattttttttttttttgcaaaggaaaaaattgatactggaaaagattgttgtgcatagttattagtcatttgtaaccttgcttaagtatttcttagtccaacatagatattttctttctcctgaccatgtattttaaaatatagtctatttcttgactttgaacttaaagctttaatcataatttctcatgtatacatcgttcttctgatggtaagctggatttgaaggtagtggtttcagtgtttcttaagttggtagctgagggtatcaggcatcagttcatgcaataatacaagaaaaaaaatcctttgcttgccaagaggtagagtgatgtgcatttatctgttttctgttctgtaagtctagaccttcaaaccatttgtaaactaacccctgggaaatttgaaattacctgataacttaagactctgtgatctctggaatcaccatatgtttcttttttgtgtagatattaataacattactctttgactatagtgtgcactctgaaatgtactcagtgaaaatttgttttgagtttcattaatgctatttcaccagttagacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaattctgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaagttcagaattcatgtgaaatacttctttggggcaaaagtccttcattcctggtatttattggattggaaatctgtagcaagatgctgtttaaaattaccatattgtttttttatcttatacttagctctctggctattgaacttccttttcttgtttgaagttagcttcaaatttgctcctatgctaaattacctgtaaatattctggataggaactacttgaaatagtaatttgttaaaagatatgacaaaatgaaaatgcttaaactacagaaatttaaaaatgccataacaatcttgcgagactaactttaaaatatactttaaatgattattatgattttggtggtaacgatcccccacacacaaccactatgaagaaataatgccgcatttttcccccattgtaccaaaaagataaaaaaatggtaaacactgatcaaggtattttgtattgtcaaggcatgcatattctaaagaattaaatgctaacttaacagcactggctttctggctggtcaactatatgaaaccttgttcattcctccgagtactgtaatgttcacacttgtacaatcttccctgtcatgactttaagttctacttttcattaaccatggcctgatattagttcttagagcttcttgtggcaaaaataaaatgatttaattct

SEQ ID NO: 34710 - DNA, 2346 bp, Homo sapiens
tttggcttcagcgcttcgcccccgcgctgtgccctctgtcggcggcgtggggcagctgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcagtgtctgttgacttcacttggcactgtttaacattccacctctggaaattgtaaagatggagagatgaggggaagggacaaggggatgaagaaagaggaaagggcatggagagtagaaaactgatttctgctacagacattcagtactctggcagtctgctgaactccttgaatgagcaacgtggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaataccagttttgatggatcattaatacagaagatgcagattcctacacttcttcaagaaccactttccaattccttaaaaatttcagatataattactagaaatactaatgatccaggcgtaggatcaaaacatctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaa

SEQ ID NO: 34711 - DNA, 6564 bp, Homo sapiens
cggggactggcctggcgccggcggcggcggagggggcgccgcgggcgggcgatgtgagcgcggcgctctggacagagtacgcttcatgtcagtagaaatggacagcagcagttttattcagtttgatgtgcccgagtacagcagcaccgttctgagccagctaaacgaactccgcctgcaggggaaactatgtgacatcattgtacacattcagggtcagccattccgagcccacaaagcagtccttgctgccagctccccatatttccgggaccattcagcgttaagtaccatgagtggcttgtcaatatcagtgattaaaaatcccaatgtgtttgagcagttgctttctttttgttacactggaagaatgtccttgcagctgaaggatgttgtcagttttctgactgcagccagctttcttcagatgcagtgtgtcattgacaagtgcacgcagatcctagagagcatccattccaaaatcagcgttggagatgttgactctgttaccgtcggtgctgaagagaatcccgagagtcgaaacggagtgaaagacagcagcttctttgccaacccagtggagatctctcctccatattgctctcagggacggcagcccaccgcaagcagtgacctccggatggagacgacccccagcaaagctttgcgcagccgcttacaggaggaggggcactcagaccgcgggagcagtgggagcgtttctgaatatgagattcagatagagggagaccatgagcaaggagacctattggtgagggagagccagatcaccgaggtgaaagtgaagatggagaagtccgaccggcccagctgttccgacagctcctccctgggtgacgatgggtaccacaccgagatggttgatggggaacaagttgtggcagtgaatgtgggctcctatggttctgtgctccagcacgcatactcctattcccaagcagcctcacagccaaccaatgtatcagaagcttttggaagtttgagtaattccagcccatccaggtccatgctgagctgtttccgaggagggcgtgcccgccagaagcgggctttgtctgtccacctgcacagtgacctgcagggcctggtgcagggctctgacagtgaagccatgatgaacaaccccgggtatgagagcagtccccgggagaggagtgcgagagggcattggtacccgtacaatgagaggttgatctgtatttactgtggaaagtccttcaaccagaaaggaagccttgataggcacatgcgactccatatgggaatcaccccctttgtgtgcaagttctgtgggaagaagtacacacggaaggaccaactggagtaccacatccggggccatacagatgataaaccattccgctgtgagatctgcgggaagtgctttccattccaaggtaccctcaaccagcacttgcggaaaaaccacccaggcgttgctgaagtcaggagtcgcattgagtcccccgagagaacagatgtgtacgtggaacagaaactagaaaatgacgcatcggcctcagagatgggcctagattcccggatggaaattcacacagtgtctgatgctcccgattaagatggtaaagaagtgcacccaaacaaagcacattaatcaatgcatatttgtgatttgctttgttgtaatctttggttttcccaaccatctggaaatctcttggtctcttggcagtttttctaaagtttctggatggaacacttcgttgtgtttatcctttcccctgccctccctccccgaaggagctcaaagcatgaagggcaacgcatccagggaaaacacaggctgacagtattcctctttggctgaactcttaatccaaaatctgccagtgatttagctatgccaactggttgaccctccattctctgccaagaggcatactctttctcattgtgtgcgctggcagcagtgcacttccacggagggagattaggatgccgtcagctgatacaaatgggtaaccttttctaatttaaaattccttttagggggtagttagacaatttatatatatatataataaaactattattatatatatagtatatatacattttcaaatttgattttattctggttgaggtgaatgtaagaggaatatataatttaatacaatgtgaacagggcttctgagtctatctcatccctacctaatatgttagggttttgccccttcatttcccttacaaaagaatgttagtaggtttatattaatcattgtgtccaaaagcaagcaaagcaaatcacagtgttcacagctctgcttcataacaaatacataaaccaaatgccataaaatttcttcaactctagttggaaaccgtttggaatttttgttagttgtccagcaggtaagctggatgacctgtggtgctgacctttttacatagtgtagtgttatattagccaaccccaaaggagcagtggttttcaaggtttttactggcctacaaatctaccttcattccgtactgtagaaacatacataccaggtaactaaatcgaatcactctctatcatgagttagtactcactcgcacttaaggaaagggatttgtagttctgtctacaaaattctccaagcagtgttgtggttttttttgtttttgttttttttctttctcttttcaaacagccagttcaggtgcacagcaactttttctacatgcagttcccagggaaactgcagaacttagaatttgtactttttgtaaagctatactctatgggaattgcaagcaatatatctatcttagtattgtgtgtgctaatgagagcctcagtggctcccccactctctcagtgtttcctgcttaaagaaccaacagtttaaaagccctctaagatactctgtgtgtcaccaaatctgtgtgtcaccattttttggtcatgtggtgctatttttgttaagtgtctttttaggtcagtatagttgtagaaaatgtgaaatctgatggtaataatgaattataattgttttcctctcttgagttcatagcttgaaaagagacctcaaaagcatgtgctggcaaacacgttactgtatgaaaacatacctgagtccatttgaataatgttttattagtactttcggaaatgtcttcagttctgtattgtgttcacatacacaaacaggctttacaagattgcttcggtactgtaaactctggcagagagtaattttgtaggcagtttggtggtgagtttgtgctgcaggctgcctgtgggatgtcagcgttctggtatctgcctgagaacctgggctctgagacgcacaaccagtgcacctccataggagaacagtgcagccacctaaaagaaaaacgaacgaaggaccagcctcagaggctagaagttaaaggaatacagaattagatgtttgctggttttctgtgcttttttggctcctaaaataccaatggtggatttgtttttgtttttgttttttgttttgagaaataaaaagtcattcaagccctttgtgtgtaatagcccccaggggtggcagctgtgcagtcgcatctctttggcacacaggatctgttcacgtgtgaactgctgcgctacacatcagtgttaactccctacagattacactctaatcccgctgctcccgaggagcggctttgctaaatcgggtatatagtatatgcctttttcctcgtcaaactgcctaagtaggggttcgttctctccctgaagcacttgttcaactcctgttaaagccgcgtgcctcaaggggaggctggaccccaagtgtttacccacttaaatatgttctggggtttcaggtaaatgtttgtgggtttttttttccttacatgaataagtttggttttgatttttttttaattgaatgcaaaaaatttgtgttgtgatacaaattaagtttgtgacaagaaatgcccaaatccaaggacataagaggtcaagctcagggaaggaacctccttttcactcaggcttggggcctccagcgaggtttccagagcattccatggtatgagagacagtgaggagggagggcacctggcgcgggcacttccagcgtcctggctcttggcattgtccgtcttaaccttatttacatggagttctttgtatttgtgaatctgtttaactggtttgagtttaccaaagagtgacttatccaaaattgtctttgacaaaaatatccattgctttgattgtacagttcaggttcaaacattgtaatgggactgttaaggggcagaaaattgattgagtttctctctaagaatcatgattccacattttgcaagttccacttgctcccattcgtgttgctaacactttaccctttccactgctcgcagtgttaagaatgaattctcaagccataacacagtactgtaaagttccgcagggcttcgagggaggcagcgcctaggccagcacggagctgtgtagcctctctgagcgttcgcactgtcatgcttcccaggggtgtgactggtgagagattaactccattcagatcgggcagcagcaattaattgtgccttgccgcatgaggatgtgtcaggaggattaacatgaccacagaaccgaaacattctctccctgaagttcacttcacgtctccgcagacgaagtacgctgtgtaactccttagagcaactctttttggaaagcaaagtccctatttctgtacagttttaggttaggtgtttcatttataacagatgcagaaatcaattaagataaagtgatatgtgaagaaatcttttacagtaaaatatatcctgaattcatataggcttgttcataattgagtctcttcttgagctaccttttcaatattagacaatgtgaagacagtgacagcgtccttttctagagatatttagcctgttattacaaactgtgaagacaaagaattttatacttttactaatgtttgtggttttaaacagttattttcattctaatcagttctctaccctctaatttctactaaagctgtaaatacatttagaaattatatttgtaaatacagtatatggagacaagttaattttttggtcagtggaaaaagcctcccaaccaattggccctgccttggcagttgtgttttttgttgttgttgttgttgttttagtttagtttttttttttaaacagcagaaaggatactgtcggttcactgttgagcagaatatactgtagaacgaaaatgataatttttaaatcttccagagcatgagtaaatgtcttttctaatgatagcaaatataaccaactctttgtttttcccttagcccagaccatatagacctgcgtattttgtgtgtggttttgtttttatttttgttcttacagcctagaccctaggaaaaatttgcaggaacacgaaacaagggctggggggaaaatcatctatgtgaatgagctttactttaaagagatcaatgtattttattttatcaactttttctcttagttactgtgatttttgttgttgttgtcctcgttattgttaaattctgtaatggtttcctgtgaagcctccactgaaagggactcaaatatgcaacacctaaactattttccaagggcacatgccccttgaatggtgcttctagactggtcagggttatttattaaattttatatatgaaagtattggggaattatgtaaattctttatatgaaactatctagttcataaatcatagatttcatattactcagtgcaactgaactaaaagttcagaaaagtcattcacattgttccaaatttgtaatggttgtcacatgtcacatgcgtctttttcagtaagtgccagagtgttcccactgtttctgcccagtgcttgacttctcggcccggaagagaacctgctttctctggtttccttcctgagtctggcacagacggggctattgtagttcttgatcaagtcctggagtcagccttgcctggctctccttgtagcagattcagtccacagacctcttgctgcccctcagtgacaagtatgctgtgaattcaacctttggacttgctgcccaagcctttggttgctgccctgactattgtaagaggtaaacttacctggtttgtttgagaatgaccattttcctaatgtgaaaaccatctctctcaccacttttattagtagggctaacatttttttccgttataaatggttgagcaatttgaatgacttaacacagtgtcattatcttgcaatataaactggtaacctcacaactccacacttcatcaccatatgaagtaaatgaagctagctaagcggatgctgtatcaactagtaacttgccattaaggattattttatagcatgaatttaagactatttattcaaatgatattttactcttgtattcactttgttttagatttgtgacatgaatatttcagtgctgcttaattttgttctgaattcttgtttcttgcttgtaaatggcttttttatggtataaataaagtcaatggacattgctgtttgtaaataaaaatgctgctagagcaaa

SEQ ID NO: 34712 - DNA, 6528 bp, Homo sapiens
gaggagtcattggtgaatgatgcaaactctctctctccgcagagtacgcttcatgtcagtagaaatggacagcagcagttttattcagtttgatgtgcccgagtacagcagcaccgttctgagccagctaaacgaactccgcctgcaggggaaactatgtgacatcattgtacacattcagggtcagccattccgagcccacaaagcagtccttgctgccagctccccatatttccgggaccattcagcgttaagtaccatgagtggcttgtcaatatcagtgattaaaaatcccaatgtgtttgagcagttgctttctttttgttacactggaagaatgtccttgcagctgaaggatgttgtcagttttctgactgcagccagctttcttcagatgcagtgtgtcattgacaagtgcacgcagatcctagagagcatccattccaaaatcagcgttggagatgttgactctgttaccgtcggtgctgaagagaatcccgagagtcgaaacggagtgaaagacagcagcttctttgccaacccagtggagatctctcctccatattgctctcagggacggcagcccaccgcaagcagtgacctccggatggagacgacccccagcaaagctttgcgcagccgcttacaggaggaggggcactcagaccgcgggagcagtgggagcgtttctgaatatgagattcagatagagggagaccatgagcaaggagacctattggtgagggagagccagatcaccgaggtgaaagtgaagatggagaagtccgaccggcccagctgttccgacagctcctccctgggtgacgatgggtaccacaccgagatggttgatggggaacaagttgtggcagtgaatgtgggctcctatggttctgtgctccagcacgcatactcctattcccaagcagcctcacagccaaccaatgtatcagaagcttttggaagtttgagtaattccagcccatccaggtccatgctgagctgtttccgaggagggcgtgcccgccagaagcgggctttgtctgtccacctgcacagtgacctgcagggcctggtgcagggctctgacagtgaagccatgatgaacaaccccgggtatgagagcagtccccgggagaggagtgcgagagggcattggtacccgtacaatgagaggttgatctgtatttactgtggaaagtccttcaaccagaaaggaagccttgataggcacatgcgactccatatgggaatcaccccctttgtgtgcaagttctgtgggaagaagtacacacggaaggaccaactggagtaccacatccggggccatacagatgataaaccattccgctgtgagatctgcgggaagtgctttccattccaaggtaccctcaaccagcacttgcggaaaaaccacccaggcgttgctgaagtcaggagtcgcattgagtcccccgagagaacagatgtgtacgtggaacagaaactagaaaatgacgcatcggcctcagagatgggcctagattcccggatggaaattcacacagtgtctgatgctcccgattaagatggtaaagaagtgcacccaaacaaagcacattaatcaatgcatatttgtgatttgctttgttgtaatctttggttttcccaaccatctggaaatctcttggtctcttggcagtttttctaaagtttctggatggaacacttcgttgtgtttatcctttcccctgccctccctccccgaaggagctcaaagcatgaagggcaacgcatccagggaaaacacaggctgacagtattcctctttggctgaactcttaatccaaaatctgccagtgatttagctatgccaactggttgaccctccattctctgccaagaggcatactctttctcattgtgtgcgctggcagcagtgcacttccacggagggagattaggatgccgtcagctgatacaaatgggtaaccttttctaatttaaaattccttttagggggtagttagacaatttatatatatatataataaaactattattatatatatagtatatatacattttcaaatttgattttattctggttgaggtgaatgtaagaggaatatataatttaatacaatgtgaacagggcttctgagtctatctcatccctacctaatatgttagggttttgccccttcatttcccttacaaaagaatgttagtaggtttatattaatcattgtgtccaaaagcaagcaaagcaaatcacagtgttcacagctctgcttcataacaaatacataaaccaaatgccataaaatttcttcaactctagttggaaaccgtttggaatttttgttagttgtccagcaggtaagctggatgacctgtggtgctgacctttttacatagtgtagtgttatattagccaaccccaaaggagcagtggttttcaaggtttttactggcctacaaatctaccttcattccgtactgtagaaacatacataccaggtaactaaatcgaatcactctctatcatgagttagtactcactcgcacttaaggaaagggatttgtagttctgtctacaaaattctccaagcagtgttgtggttttttttgtttttgttttttttctttctcttttcaaacagccagttcaggtgcacagcaactttttctacatgcagttcccagggaaactgcagaacttagaatttgtactttttgtaaagctatactctatgggaattgcaagcaatatatctatcttagtattgtgtgtgctaatgagagcctcagtggctcccccactctctcagtgtttcctgcttaaagaaccaacagtttaaaagccctctaagatactctgtgtgtcaccaaatctgtgtgtcaccattttttggtcatgtggtgctatttttgttaagtgtctttttaggtcagtatagttgtagaaaatgtgaaatctgatggtaataatgaattataattgttttcctctcttgagttcatagcttgaaaagagacctcaaaagcatgtgctggcaaacacgttactgtatgaaaacatacctgagtccatttgaataatgttttattagtactttcggaaatgtcttcagttctgtattgtgttcacatacacaaacaggctttacaagattgcttcggtactgtaaactctggcagagagtaattttgtaggcagtttggtggtgagtttgtgctgcaggctgcctgtgggatgtcagcgttctggtatctgcctgagaacctgggctctgagacgcacaaccagtgcacctccataggagaacagtgcagccacctaaaagaaaaacgaacgaaggaccagcctcagaggctagaagttaaaggaatacagaattagatgtttgctggttttctgtgcttttttggctcctaaaataccaatggtggatttgtttttgtttttgttttttgttttgagaaataaaaagtcattcaagccctttgtgtgtaatagcccccaggggtggcagctgtgcagtcgcatctctttggcacacaggatctgttcacgtgtgaactgctgcgctacacatcagtgttaactccctacagattacactctaatcccgctgctcccgaggagcggctttgctaaatcgggtatatagtatatgcctttttcctcgtcaaactgcctaagtaggggttcgttctctccctgaagcacttgttcaactcctgttaaagccgcgtgcctcaaggggaggctggaccccaagtgtttacccacttaaatatgttctggggtttcaggtaaatgtttgtgggtttttttttccttacatgaataagtttggttttgatttttttttaattgaatgcaaaaaatttgtgttgtgatacaaattaagtttgtgacaagaaatgcccaaatccaaggacataagaggtcaagctcagggaaggaacctccttttcactcaggcttggggcctccagcgaggtttccagagcattccatggtatgagagacagtgaggagggagggcacctggcgcgggcacttccagcgtcctggctcttggcattgtccgtcttaaccttatttacatggagttctttgtatttgtgaatctgtttaactggtttgagtttaccaaagagtgacttatccaaaattgtctttgacaaaaatatccattgctttgattgtacagttcaggttcaaacattgtaatgggactgttaaggggcagaaaattgattgagtttctctctaagaatcatgattccacattttgcaagttccacttgctcccattcgtgttgctaacactttaccctttccactgctcgcagtgttaagaatgaattctcaagccataacacagtactgtaaagttccgcagggcttcgagggaggcagcgcctaggccagcacggagctgtgtagcctctctgagcgttcgcactgtcatgcttcccaggggtgtgactggtgagagattaactccattcagatcgggcagcagcaattaattgtgccttgccgcatgaggatgtgtcaggaggattaacatgaccacagaaccgaaacattctctccctgaagttcacttcacgtctccgcagacgaagtacgctgtgtaactccttagagcaactctttttggaaagcaaagtccctatttctgtacagttttaggttaggtgtttcatttataacagatgcagaaatcaattaagataaagtgatatgtgaagaaatcttttacagtaaaatatatcctgaattcatataggcttgttcataattgagtctcttcttgagctaccttttcaatattagacaatgtgaagacagtgacagcgtccttttctagagatatttagcctgttattacaaactgtgaagacaaagaattttatacttttactaatgtttgtggttttaaacagttattttcattctaatcagttctctaccctctaatttctactaaagctgtaaatacatttagaaattatatttgtaaatacagtatatggagacaagttaattttttggtcagtggaaaaagcctcccaaccaattggccctgccttggcagttgtgttttttgttgttgttgttgttgttttagtttagtttttttttttaaacagcagaaaggatactgtcggttcactgttgagcagaatatactgtagaacgaaaatgataatttttaaatcttccagagcatgagtaaatgtcttttctaatgatagcaaatataaccaactctttgtttttcccttagcccagaccatatagacctgcgtattttgtgtgtggttttgtttttatttttgttcttacagcctagaccctaggaaaaatttgcaggaacacgaaacaagggctggggggaaaatcatctatgtgaatgagctttactttaaagagatcaatgtattttattttatcaactttttctcttagttactgtgatttttgttgttgttgtcctcgttattgttaaattctgtaatggtttcctgtgaagcctccactgaaagggactcaaatatgcaacacctaaactattttccaagggcacatgccccttgaatggtgcttctagactggtcagggttatttattaaattttatatatgaaagtattggggaattatgtaaattctttatatgaaactatctagttcataaatcatagatttcatattactcagtgcaactgaactaaaagttcagaaaagtcattcacattgttccaaatttgtaatggttgtcacatgtcacatgcgtctttttcagtaagtgccagagtgttcccactgtttctgcccagtgcttgacttctcggcccggaagagaacctgctttctctggtttccttcctgagtctggcacagacggggctattgtagttcttgatcaagtcctggagtcagccttgcctggctctccttgtagcagattcagtccacagacctcttgctgcccctcagtgacaagtatgctgtgaattcaacctttggacttgctgcccaagcctttggttgctgccctgactattgtaagaggtaaacttacctggtttgtttgagaatgaccattttcctaatgtgaaaaccatctctctcaccacttttattagtagggctaacatttttttccgttataaatggttgagcaatttgaatgacttaacacagtgtcattatcttgcaatataaactggtaacctcacaactccacacttcatcaccatatgaagtaaatgaagctagctaagcggatgctgtatcaactagtaacttgccattaaggattattttatagcatgaatttaagactatttattcaaatgatattttactcttgtattcactttgttttagatttgtgacatgaatatttcagtgctgcttaattttgttctgaattcttgtttcttgcttgtaaatggcttttttatggtataaataaagtcaatggacattgctgtttgtaaataaaaatgctgctagagc

SEQ ID NO: 34713 - DNA, 3650 bp, Homo sapiens
agttctcagacaggctgcccagaggggctccagcataagcaggagacatgatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagggcaagtttcaaaaaggtctccgactccatgagaacagctagcctttgcctggagaggacggacgtctgccacgaggcagagcctgtccgcacacttgccgagcactcatacgctgtttcttccgtagctgaagcttacagaagtcagcctgtacgtgaacatgatggcagttcacctggtaacacagggaaagaaaattgtgaagcccttgcagcgaaaccgaaaacatgccggaagccaaagacattctccataccacaggattcggattcagccacagaaaatataccaccccctccagtatccaacttagaggttaatcaagaaagaagtccacaaccagctgctgttctcactcgttcaaaatctccaaacaatgaaggagatgtccatttttccagggaagatgaaaatcaatcttctgatgttcccgggccgccagccgcagaggttccacctctggtgtacaattgtagctgctgttccaaagcctttgacagcagcactctgctcagtgcccacatgcagcttcacaagccaacccaggagcctttagtgtgcaagtattgcaacaaacaattcaccaccctgaacaggttggatcggcatgaacagatctgcatgaggtcaagccacatgcccattcctggaggaaaccaacgctttttagaaaactatcctaccattggacaaaatggaggttcattcacaggtccagaacctttattatctgaaaataggattggtgaattttccagtaccggaagtactttgccagacacggaccacatggttaaatttgttaatgggcaaatgctctacagttgcgttgtgtgcaaacgtagttatgtgaccttatctagcctccgaagacatgcaaatgttcactcctggagaagaacatatccttgccattactgcaacaaagtatttgcattggctgagtacaggacaaggcatgaaatttggcatacgggagaaagacgatatcagtgcattttctgtcttgaaactttcatgacctactatatactcaaaaatcatcagaagtctttccatgccatcgatcatagactttccatcagtaaaaaaacagcaaatggaggcttgaagcctagtgtctatccgtataaactttataggctactgcctatgaaatgcaagagagccccttataagagctaccgaaattcttcctatgaaaatgcacgagaaaacagtcaaatgaatgagtctgcacctggtacctatgttgttcagaatccacacagctctgaattaccaacgctgaatttccaagatactgtaaacaccctgaccaacagtccagccatcccattggaaacatctgcatgtcaggacatacccacttctgccaatgtacaaaatgcagagggtaccaaatggggagaggaggcattgaaaatggatcttgacaataacttttattcaactgaggtgtcagtttcttccactgaaaatgctgtcagttctgacctccgggcaggggatgtacctgttttatctttgagtaatagcagtgagaatgccgcctctgtgatcagctacagtggctctgcaccctcggtcattgtacacagcagccagttttcatcggtgatcatgcacagcaatgccattgctgccatgaccagcagcaaccacagagccttttcagacccagctgtcagtcagtccctgaaagatgacagtaagcccgagccagataaagtgggtaggtttgcaagcagacccaaaagcattaaggagaaaaagaaaactacatcacataccaggggagaaataccggaggagtcaaactatgttgctgatcctggaggatcactgagcaaaaccacaaatattgctgaagaaaccagcaaaattgaaacctacattgcaaaacctgctctgccgggaacctccacaaatagtaatgttgcacccctttgccaaataacagtgaaaattggaaacgaagccattgtgaaaaggcacattctaggatctaaattgttttataaaagagggagaagacccaagtatcagatgcaggaggagcctttgccacaggggaatgacccagaacccagtggagacagcccactcgggctttgccaatccgagtgcatggagatgagtgaagtgttcgatgacgcaagtgaccaggattccactgacaaaccgtggcgcccttactacaactacaaacccaaaaagaaatccagacagttgaaaaaaatgaggaaagtcaactggaggaaggagcacggaaacaggagcccgagccataaatgtaaatacccagcagaactggattgcgccgtggggaaggctcctcaggataaaccctttgaggaagaagaaactaaagagatgcccaagctgcagtgtgaactctgtgatggagacaaagcagtgggggctggaaaccaaggaaggccccaccgacatcttacttctcggccatatgcctgcgagctctgcgccaagcagttccagagcccttccacactcaaaatgcacatgagatgtcacaccggggagaagccataccagtgcaagacctgcggacggtgcttttcggtgcaaggaaacttacagaaacatgaacgcatccacctgggcttgaaggagttcgtctgtcagtattgcaacaaggcattcaccttgaatgagaccctcaaaatccatgaaagaatccatactggagaaaagcgttaccactgtcagttctgctttcagagatttttgtatctctccaccaaaaggaatcacgagcagaggcatattcgggagcataatgggaagggctatgcctgcttccagtgccccaaaatttgcaaaacagctgctgcccttggaatgcaccaaaagaaacacttattcaaaagcccaagtcagcaggagaaaataggtgacgtgtgccacgaaaactcaaatcccttggagaatcaacatttcattggttcagaagacaatgaccaaaaggataacatacaaaccggtgtggaaaatgttgtcctttgagtggcaagaatt

SEQ ID NO: 34714 - DNA, 3662 bp, Homo sapiens
agttctcagacaggctgcccagaggggctccagcataagcaggagacatgatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagggcaagtttcaaaaaggtctccgactccatgagaacagctagcctttgcctggagaggacggacgtctgccacgaggcagagcctgtccgcacacttgccgagcactcatacgctgtttcttccgtagctgaagcttacagaagtcagcctgtacgtgaacatgatggcagttcacctggtaacacagggaaagaaaattgtgaagcccttgcagcgaaaccgaaaacatgccggaagccaaagacattctccataccacaggattcggattcagccacagaaaatataccaccccctccagtatccaacttagaggttaatcaagaaagaagtccacaaccagctgctgttctcactcgttcaaaatctccaaacaatgaaggagatgtccatttttccagggaagatgaaaatcaatcttctgatgttcccgggccgccagccgcagaggttccacctctggtgtacaattgtagctgctgttccaaagcctttgacagcagcactctgctcagtgcccacatgcagcttcacaagccaacccaggagcctttagtgtgcaagtattgcaacaaacaattcaccaccctgaacaggttggatcggcatgaacagatctgcatgaggtcaagccacatgcccattcctggaggaaaccaacgctttttagaaaactatcctaccattggacaaaatggaggttcattcacaggtccagaacctttattatctgaaaataggattggtgaattttccagtaccggaagtactttgccagacacggaccacatggttaaatttgttaatgggcaaatgctctacagttgcgttgtgtgcaaacgtagttatgtgaccttatctagcctccgaagacatgcaaatgttcactcctggagaagaacatatccttgccattactgcaacaaagtatttgcattggctgagtacaggacaaggcatgaaatttggcatacgggagaaagacgatatcagtgcattttctgtcttgaaactttcatgacctactatatactcaaaaatcatcagaagtctttccatgccatcgatcatagactttccatcagtaaaaaaacagcaaatggaggcttgaagcctagtgtctatccgtataaactttataggctactgcctatgaaatgcaagagagccccttataagagctaccgaaattcttcctatgaaaatgcacgagaaaacagtcaaatgaatgagtctgcacctggtacctatgttgttcagaatccacacagctctgaattaccaacgctgaatttccaagatactgtaaacaccctgaccaacagtccagccatcccattggaaacatctgcatgtcaggacatacccacttctgccaatgtacaaaatgcagagggtaccaaatggggagaggaggcattgaaaatggatcttgacaataacttttattcaactgaggtgtcagtttcttccactgaaaatgctgtcagttctgacctccgggcaggggatgtacctgttttatctttgagtaatagcagtgagaatgccgcctctgtgatcagctacagtggctctgcaccctcggtcattgtacacagcagccagttttcatcggtgatcatgcacagcaatgccattgctgccatgaccagcagcaaccacagagccttttcagacccagctgtcagtcagtccctgaaagatgacagtaagcccgagccagataaagtgggtaggtttgcaagcagacccaaaagcattaaggagaaaaagaaaactacatcacataccaggggagaaataccggaggagtcaaactatgttgctgatcctggaggatcactgagcaaaaccacaaatattgctgaagaaaccagcaaaattgaaacctacattgcaaaacctgctctgccgggaacctccacaaatagtaatgttgcacccctttgccaaataacagtgaaaattggaaacgaagccattgtgaaaaggcacattctaggatctaaattgttttataaaagagggagaagacccaagtatcagatgcaggaggagcctttgccacaggggaatgacccagaacccagtggagacagcccactcgggctttgccaatccgagtgcatggagatgagtgaagtgttcgatgacgcaagtgaccaggattccactgacaaaccgtggcgcccttactacaactacaaacccaaaaagaaatccagacagttgaaaaaaatgaggaaagtcaactggaggaaggagcacggaaacaggagcccgagccataaatgtaaatacccagcagaactggattgcgccgtggggaaggctcctcaggataaaccctttgaggaagaagaaactaaagagatgcccaagctgcagtgtgaactctgtgatggagacaaagcagtgggggctggaaaccaaggaaggccccaccgacatcttacttctcggccatatgcctgcgagctctgcgccaagcagttccagagcccttccacactcaaaatgcacatgagatgtcacaccggggagaagccataccagtgcaagacctgcggacggtgcttttcggtgcaaggaaacttacagaaacatgaacgcatccacctgggcttgaaggagttcgtctgtcagtattgcaacaaggcattcaccttgaatgagaccctcaaaatccatgaaagaatccatactggagaaaagcgttaccactgtcagttctgctttcagagatttttgtatctctccaccaaaaggaatcacgagcagaggcatattcgggagcataatgggaagggctatgcctgcttccagtgccccaaaatttgcaaaacagctgctgcccttggaatgcaccaaaagaaacacttattcaaaagcccaagtcagcaggagaaaataggtgacgtgtgccacgaaaactcaaatcccttggagaatcaacatttcattggttcagaagacaatgaccaaaaggataacatacaaaccggtgtggaaaatgttgtcctttgagtggcaagaattagaaaaatcttc

SEQ ID NO: 34715 - DNA, 578 bp, Homo sapiens
gcatttttctacaagcctgccggcaccatttaggattttgaaaaataatctagaaatgctataccctttatcaaaattattttttactttgcaagagcttaacagttttggttttttcttagcaattctataaaattaacatctataaaatgcatcccggaccagatacatactgtattgaaagctttcttcaggaagagaatatgagagtgttctttccagcttattttcttccttagcaaaaggattgtttgattctcagaagcagaaggacacattcattgtggagcagctctgcttaagtttgaaccaagactctgaggctgatatgcaatgtcacttacaacattaatcagatactgcatttaagatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatg

SEQ ID NO: 34716 - DNA, 590 bp, Homo sapiens
agcgctgcggccggactcacgggtccggaagcaccatggacccccggggaaacgcgccggcggcgaaggagccgagccccatcttgatgtggaagaaatggaggactcagaaccaaggatttccaagtgatttcttccaaagcacaggaatctcactctgttaaagctggtctgttctaactgagacggagtttcgctcttgttgcccaggctggagtacaatggcgcaatcttggctcaccacaacctccgcctcccgggttcaagcagttcttctctctcagcctcccgagtagctgggattacagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttcc

SEQ ID NO: 34717 - DNA, 593 bp, Homo sapiens
tatttctggagtagttgtgggagagagatgtactccaaagagaagaggactcttgctatggttcagttgaaccaagactctgaggctgatatgcaatgtcacttacaacattaatcagatactgcatttaagatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttctt

SEQ ID NO: 34718 - DNA, 855 bp, Homo sapiens
aggttgtccaagctggcctccctctctgctgagtgcactccagcagcttcccgatgttggcctttagaacagcctgaatttcagttaaaaaataagcttcccctgtcacacgatgccttcttgaatctgatagcttaagtgcagtaaaatctgataaatgtagcttttctgtgcccgtttcaggccacatttagaaggcaacatcaacaggattttccttttcctagacacagctcaactccataaaggacttctgttttgtaatctgttttcgagatctgatgcgtgtgtttctaacaccccgtcacgtgaggaggtctgacgtagtcacccaacatgactttgagaaaatatactgtaaagatgtgtgtgggatggtacagccagctcactgaagcaaaatatcctttgtcggaaaactttccgcagggaataacagacctgcgcagtagatttcactttgatatggcccctgtgctggcccagtatggactgcaggtttgacttttgcaggattccagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaa

SEQ ID NO: 34719 - DNA, 1434 bp, Homo sapiens
cacagaagccctctagccaaggcctcgggcagccctaccaaatgaatatgggcacttgagttttctaggagggctttcctgctgccctgggtctcatccaactggtatccatctaaacattcccacccagggttattcatgctagaggaagaagaatgccctttccagagccagttcttggggaaaagaggaactgttgatatagccagagcccgaaaagaagattactctgcaacagctaaagcctcacgaaagattttacttgtagatcaactttcaaaatgtaggaagtcagaatgggtgacatcatcagaaaaatatgtggagctgatcacaagaagtgaagaacccagagcacgaaagcggttgtgactcctgggcccagggagttgacagcgtctgggtttcagaggagccagcgcctccgagttgtcttgaagtgaggctctgctgtagtcctgttcttctggctctaagatctgaatgttgtgaccactaatttgctctttcctggagagtaaccccagtttggtccacaaggcttgctgcccaatctttgccaacagttgaaccaagactctgaggctgatatgcaatgtcacttacaacattaatcagatactgcatttaaggttcacagtgtcttcacctggaatagattccacctcaagaaaccagtttctttgctcatccataagaagcaactcctcatctgatcaagttttataataagattgcagaaattcagtctcatctttaggctccacttctagttcttatgctatttccaccacatctgcagttacttcctccactgaagtcttgaatctctcaaagtcatccatgagggttggaaccaacatcttccaaactcctgatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaa

SEQ ID NO: 34720 - DNA, 2659 bp, Homo sapiens
gcagtctcagaaaaaccttggatgagaaacttcttttttcaatcctgttttcctgttgataaattcagttctgtgatcacagttcattcaagctgttctgcgtatgatttttgtgtgtatgtgacaattgcatctaaaacttgtgagcaagaagacagagaaatcagttggtctccatcgctttacataaaaatggctgagtgtcttgtcatgctagcactgcattaagtgatgcatacagatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagggcaagtttcaaaaaggtctccgactccatgagaacagctagcctttgcctggagaggacggacgtctgccacgaggcagagcctgtccgcacacttgccgagcactcatacgctgtttcttccgtagctgaagcttacagaagtcagcctgtacgtgaacatgatggcagttcacctggtaacacagggaaagaaaattgtgaagcccttgcagcgaaaccgaaaacatgccggaagccaaagacattctccataccacaggattcggattcagccacagaaaatataccaccccctccagtatccaacttagaggttaatcaagaaagaagtccacaaccagctgctgttctcactcgttcaaaatctccaaacaatgaaggagatgtccatttttccagggaagatgaaaatcaatcttctgatgttcccgggccgccagccgcagaggttccacctctggtgtacaattgtagctgctgttccaaagcctttgacagcagcactctgctcagtgcccacatgcagcttcacaagccaacccaggagcctttagtgtgcaagtattgcaacaaacaattcaccaccctgaacaggttggatcggcatgaacagatctgcatgaggtcaagccacatgcccattcctggaggaaaccaacgctttttagaaaactatcctaccattggacaaaatggaggttcattcacaggtccagaacctttattatctgaaaataggattggtgaattttccagtaccggaagtactttgccagacacggaccacatggttaaatttgttaatgggcaaatgctctacagttgcgttgtgtgcaaacgtagttatgtgaccttatctagcctccgaagacatgcaaatgttcactcctggagaagaacatatccttgccattactgcaacaaagtatttgcattggctgagtacaggacaaggcatgaaatttggcatacgggagaaagacgatatcagtgcattttctgtcttgaaactttcatgacctactatatactcaaaaatcatcagaagtctttccatgccatcgatcatagactttccatcagtaaaaaaacagcaaatggaggcttgaagcctagtgtctatccgtataaactttataggctactgcctatgaaatgcaagagagccccttataagagctaccgaaattcttcctatgaaaatgcacgagaaaacagtcaaatgaatgagtctgcacctggtacctatgttgttcagaatccacacagctctgaattaccaacgctgaatttccaagatactgtaaacaccctgaccaacagtccagccatcccattggaaacatctgcatgtcaggacatacccacttctgccaatgtacaaaatgcagagggtaccaaatggggagaggaggcattgaaaatggatcttgacaataacttttattcaactgaggtgtcagtttcttccactgaaaatgctgtcagttctgacctccgggcaggggatgtacctgttttatctttgagtaatagcagtgagaatgccgcctctgtgatcagctacagtggctctgcaccctcggtcattgtacacagcagccagttttcatcggtgatcatgcacagcaatgccattgctgccatgaccagcagcaaccacagagccttttcagacccagctgtcagtcagtccctgaaagatgacagtaagcccgagccagataaagtgggtaggtttgcaagcagaccc

SEQ ID NO: 34721 - DNA, 644 bp, Homo sapiens
attttctgggcggtgctgtgcagcgctgcggccggactcacgggtccggaagcaccatggacccccggggaaacgcgccggcggcgaaggagccgagccccatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaa

SEQ ID NO: 34722 - DNA, 859 bp, Homo sapiens
aggctgcccagaggggctccagcataagcaggagacatggagactcttgcctccatcatggaggaggttcacaccagaagccagctctgcccttggagactctcttcccccagtgctcccctgaagcttcacactcaccagtctcatgctgcaccctgaccggcaggtccctagcatgagccccataatccctggggactgcattatcacagaccagtaataagaagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagggcaagtttcaaaaaggtctccgactccatgagaacagctagcctttgcctggagaggacggacgtctgccacga

SEQ ID NO: 34723 - DNA, 591 bp, Homo sapiens
aaccaagactctgaggctgatatgcaatgtcacttacaacattaatcagatactgcatttaagatcttgatgtggaagaaatggaggactcagaaccaaggatttccaagtgatttcttccaaagcacaggaatctcactctgttaaagctggtctgttctaactgaggctggagtacaatggcgcaatcttggctcaccacaacctccgcctcccgggttcaagcagttcttctctctcagcctcccgagtagctgggattacagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcag

SEQ ID NO: 34724 - DNA, 649 bp, Homo sapiens
ctcgagtccagcgggctcgggcactgctttgacagtcacacctcccgtctcctggattgggaatcggaccctagtcctgaccctatgggaacttgatgatttccttgatgcaacaccaagcccctggaattgaaagggacgtgcaaaggcagggacctgcccccaggggtttgcagtctcagccgcctacttctgcagtagtaaggtctgctctgttggtacaacatacaacacaaccgcccgccgttagccactttttttatagggtacatcataaatcacctgagattttagtctgtccgcggttccactttataactcctgcactgcggtagatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttc

SEQ ID NO: 34725 - DNA, 7683 bp, Homo sapiens
agttggtctccatcgctttacataaaaatggctgagtgtcttgtcatgctagcactgcattaagtgatgcatacagatcttgatgtggaagaaatggaggactcagaaccaaggatttccaagtgatttcttccaaagcacaggaatctcactctgttaaagctggtctgttctaactgaggctggagtacaatggcgcaatcttggctcaccacaacctccgcctcccgggttcaagcagttcttctctctcagcctcccgagtagctgggattacagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaatgaaaaaaggcatgaagaaccagccatcactaatgggccaaggatcacaaatgcattttccatcatcgaaacagaaaatagtaataacatgttttccccgctggacttgagggcaagtttcaaaaaggtctccgactccatgagaacagctagcctttgcctggagaggacggacgtctgccacgaggcagagcctgtccgcacacttgccgagcactcatacgctgtttcttccgtagctgaagcttacagaagtcagcctgtacgtgaacatgatggcagttcacctggtaacacagggaaagaaaattgtgaagcccttgcagcgaaaccgaaaacatgccggaagccaaagacattctccataccacaggattcggattcagccacagaaaatataccaccccctccagtatccaacttagaggttaatcaagaaagaagtccacaaccagctgctgttctcactcgttcaaaatctccaaacaatgaaggagatgtccatttttccagggaagatgaaaatcaatcttctgatgttcccgggccgccagccgcagaggttccacctctggtgtacaattgtagctgctgttccaaagcctttgacagcagcactctgctcagtgcccacatgcagcttcacaagccaacccaggagcctttagtgtgcaagtattgcaacaaacaattcaccaccctgaacaggttggatcggcatgaacagatctgcatgaggtcaagccacatgcccattcctggaggaaaccaacgctttttagaaaactatcctaccattggacaaaatggaggttcattcacaggtccagaacctttattatctgaaaataggattggtgaattttccagtaccggaagtactttgccagacacggaccacatggttaaatttgttaatgggcaaatgctctacagttgcgttgtgtgcaaacgtagttatgtgaccttatctagcctccgaagacatgcaaatgttcactcctggagaagaacatatccttgccattactgcaacaaagtatttgcattggctgagtacaggacaaggcatgaaatttggcatacgggagaaagacgatatcagtgcattttctgtcttgaaactttcatgacctactatatactcaaaaatcatcagaagtctttccatgccatcgatcatagactttccatcagtaaaaaaacagcaaatggaggcttgaagcctagtgtctatccgtataaactttataggctactgcctatgaaatgcaagagagccccttataagagctaccgaaattcttcctatgaaaatgcacgagaaaacagtcaaatgaatgagtctgcacctggtacctatgttgttcagaatccacacagctctgaattaccaacgctgaatttccaagatactgtaaacaccctgaccaacagtccagccatcccattggaaacatctgcatgtcaggacatacccacttctgccaatgtacaaaatgcagagggtaccaaatggggagaggaggcattgaaaatggatcttgacaataacttttattcaactgaggtgtcagtttcttccactgaaaatgctgtcagttctgacctccgggcaggggatgtacctgttttatctttgagtaatagcagtgagaatgccgcctctgtgatcagctacagtggctctgcaccctcggtcattgtacacagcagccagttttcatcggtgatcatgcacagcaatgccattgctgccatgaccagcagcaaccacagagccttttcagacccagctgtcagtcagtccctgaaagatgacagtaagcccgagccagataaagtgggtaggtttgcaagcagacccaaaagcattaaggagaaaaagaaaactacatcacataccaggggagaaataccggaggagtcaaactatgttgctgatcctggaggatcactgagcaaaaccacaaatattgctgaagaaaccagcaaaattgaaacctacattgcaaaacctgctctgccgggaacctccacaaatagtaatgttgcacccctttgccaaataacagtgaaaattggaaacgaagccattgtgaaaaggcacattctaggatctaaattgttttataaaagagggagaagacccaagtatcagatgcaggaggagcctttgccacaggggaatgacccagaacccagtggagacagcccactcgggctttgccaatccgagtgcatggagatgagtgaagtgttcgatgacgcaagtgaccaggattccactgacaaaccgtggcgcccttactacaactacaaacccaaaaagaaatccagacagttgaaaaaaatgaggaaagtcaactggaggaaggagcacggaaacaggagcccgagccataaatgtaaatacccagcagaactggattgcgccgtggggaaggctcctcaggataaaccctttgaggaagaagaaactaaagagatgcccaagctgcagtgtgaactctgtgatggagacaaagcagtgggggctggaaaccaaggaaggccccaccgacatcttacttctcggccatatgcctgcgagctctgcgccaagcagttccagagcccttccacactcaaaatgcacatgagatgtcacaccggggagaagccataccagtgcaagacctgcggacggtgcttttcggtgcaaggaaacttacagaaacatgaacgcatccacctgggcttgaaggagttcgtctgtcagtattgcaacaaggcattcaccttgaatgagaccctcaaaatccatgaaagaatccatactggagaaaagcgttaccactgtcagttctgctttcagagatttttgtatctctccaccaaaaggaatcacgagcagaggcatattcgggagcataatgggaagggctatgcctgcttccagtgccccaaaatttgcaaaacagctgctgcccttggaatgcaccaaaagaaacacttattcaaaagcccaagtcagcaggagaaaataggtgacgtgtgccacgaaaactcaaatcccttggagaatcaacatttcattggttcagaagacaatgaccaaaaggataacatacaaaccggtgtggaaaatgttgtcctttgagtggcaagaattagaaaaatcttcaaaaatatagttggtggtttttttagttatgatttaagtttagtttcattttgtccatgtgacagtcatgaaggagtgaaattaaaaaaaaaaaaaactcatttgtgaaaattccagaaaaaggatcctaatatctactttgggttttagcattaactttatgcaaagtgcacaaaaacaaaatagctgactcctccaatatcccaagtttcttgtgaaagttaataaaattcttagctgtggtatttctaccagtgaaaaaaggagtttaattttagcctagtttaaaactttctaataattgctaataagaactggctgctgaactgtctttagtcactggagaaaataagggtcagatatcctgaagatggcatcttcgtaaatatgttacgtggtaataagctgtgtgacggtctttattcccatctggcttctgcactattaaaatttgtttaaattaatggatacacatgaaatacttaaacaatataactgaaattatgtgcataatgagtaacctaaagtaggacattcatacattatgtagaactacttttctgcaacacaaaccttgtaaaatacatatataaatcactataacttttaactgtccatatcccctgtagagaattatgaggagcaatagatctgcaaataatgaggactgatgtaaaaatcaatagaaagcattttgaatatgatttaagagcatgtgaatgcttttagatggaatgctgttcccttgaagttatggctgagctgttcttagaactggtctactcaattcacagaaaacataggtcatgccttatctatgggggaacaccctcccagaatttacctgtgattacctgtgctgcatattactttgcaatggcctcatctcagagaatgaaagagggtcacattgttctgaaactctctgcagtcttccaaccaccacaaggccatggatgtgggggtctattccagacagacttaagggctcaagtggaacctgccatctcccattccactgaaggactgtccaagagatttagtgcaaggtacactgcagtagtgaattcccaggcacttgaaagtgactgcctaatccctacaattactagccttgttggagattatgcagcccacaagtacagactagtataaagcaaaaggacaaaggaacccccaccctccaccccacccattaatgacttgagtgggcaagaagaagtgatggccttccttgcctaaaacagtagctttgtttttagggggtgggaaggtaggatgtggagtgacatggttctatcctttacttatgagactcagaaatatatctacaaagccagatgctctgtcttcatatttgcagacatctagaccccttgctaaaaacccactgaagttttttttttatgttctttgacccacaccatcaacactaccctcaaatctaattgccctacagcatattctatcatgtggactaggttcctggaaagccggaactcatgattctttttcaaactgccagaatagaagggagagagaaaacatttctaccctttgatcaccagtgtgaacagaatccggaatgcagtttcagcgtgacctgcagtcattcatgttcattggatttgacagatggaaacccaaggttatcgaagattggaaggttatcattgtgaagaagtagctcaaaggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacattaagtctctttttaaatgttttcatgttatttcttttgtgcagctatttcatctgtgtgagtcacagctttgtttccacgtattattcagtttatttctgtttccttacttgtttacattccgtggtacctacttacatgcttaggagtcaaatggattatgacattaggaaaaaagcagaataaaagagattgaagtcttctgatgattgagtgttttggataggcctgatcttataatgataaatcagagaatgaaatgctctccaggaagcattctgctccactcatccgtgggaaacaaattacatttattgagtaccaggcactgggcaatgtctttacataggctatttcattaacacacacgcaccagaattcgacctcattatcctcgttttatagtgactttgagaaggtctcacaaccagacaaagccaggatgctaacctaggtctgcctgactccaaagcccatgtttttgttccttctcaacactgtagagaaaaatcatttatagaaactgaacagagtatgaggaaaggagatatgataaagtaatgcagctttaggatggcagttagtgactgccctggaacaggattaaaggaggctgtgtcaggttcagcttcccctgaattgggcttcccttatatctcaggagattgccctataaaatcagtaaaatttgtgcacttttttaaggatatggagtaaaattgtaatagcattataagctggtaattttcacacaaagaaaaaaatacgttccgtcgtcacagactctactcctaaacttagctaactaactatcttgcaaatgcctgcagtttgtcccagtgggcaatgtgagaggggatgtcggtggctcaggcagcacagtccatcaccaacacagagaaaattactgccaggcctaccggtggctggccagtagcatcaattttgtattggaagggcaatccaaaccagattcaccaaaaatttgataactgttatctgctaaaactaacttcattatgtacaagaacaacagatttaatattgaaagcatctgtaacaattgggaaagtaaaagcataaaacaaaa

SEQ ID NO: 34726 - DNA, 5891 bp, Homo sapiens
cagggagagaagaatttttttctttaatcccaccgcctctcctcgctgctcccttttgcactgaggcttaaggtttgaagactcgagggtaaaattgggccgctttcattctagtttggacaacggtttcatcttcagcaaaagcctctcattcgtagccccccccagctggaaaatggtctgctctgcgaatcgaaggaagaggcccagcagaagggactcgctgagccaccccccgccccactccatgttggctgtgctctcaggctggcaccatgcccccccctgcagaggtgacggacccgtcccatgcccccgccgtcctgcgccagctcaatgaacagcggctccgtggcctcttctgtgacgtcaccctcatagccggagacaccaagttccctgctcaccgcagcgtcctggctgcttcaagtcccttcttcagagaggccctgctcacttcagccccactaccccttccaccagctactgggggcgccgcacccaaccctgccaccaccacagctgcctcttcctcctcctcctcttcctcgtcttcttcctcttcttcctcctctgcttcttcttcttcttcctcttcctcttcctctccccctccagcctctccccctgcttcttccccaccccgggtcctggagttgccaggagtcccagcagctgcgttttctgatgtcctcaacttcatctacagcgcccggctcgcactgcctggtggtggaggggacggggcagctgtagcagagattggagctttggggcgccgtctgggcatctcccgccttcagggcctgggggagggaggtgatgcctgggtacctcctaccccagcccccatggccacctcgcagcctgaagaggacagctttgggcccgggcccaggccagctggggagtgggagggtgacagggctgaggcccaggcccctgacttgcagtgctccctgccccggcggcccctcccctgcccccagtgtggaaaaagcttcatccatcccaaacggctgcagacccatgaggcccagtgccgacgaggggccagcacgcgggggtctacagggctgggagctgggggcgctggccctggtggtcctgcaggggtggacgcctcagccctgcctccaccagtgggcttccgagggggccccgagcacgtggtgaaggtggtgggcggccacgtgctgtatgtgtgcgcggcctgcgagcgttcctacgtgaccctgtccagtctgaagagacacagcaatgtacactcgtggcggaggaagtacccctgccgctattgtgagaaagtgtttgctctggcggagtaccgcacgaagcatgaagtgtggcacacgggggagcgcaggtaccagtgcatcttctgttgggagacctttgtcacttactataacctgaagacccaccagcgagccttccacggcattagcccgggcctccttgccagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgccttgttctgaagctttctctaagcccttcccagttgcttcctagcacattccattctttgtggcccagggcctggaccagaccattgtgatacctgaccccgcccacctgggagtgtggctttgggtttcatccttccccagcgtgggtctctacgtccctgtttcccttgtatcaagacaccttcctcagcttccatgcctttggatcttccatgttcctccccatattcctggacttcggagatggcctctcccaagccaggtcaaggaggtttgggggagggttgcccctctgcccctctgttctgtggctgagcactttcccagtccagggcagggaaatattggccctatcttgacccccaaatccagtgagctccagattcttccaaggcaaaagaggtaagcagatcacacctctttctgcctctacatatggcctattctgggctagaccagatttgggggccaggagggaagaactccatatgggatggagaagggaatctactttctccctgtttttttttcctgatggtttctcccagactagaccaaatagccagaaaaatgataggggtcggatgggtgggtaagcccaggatttgcacatgaccttccatccttacctgtattcccatctccccagtgtcactcccctcaccaatcactccagatggttttgggggaaccattctactcttctggtgggctttggggtatccccaccaactttcccttcaaaatagcaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaaaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggttgaggatggaccggagaattggaacttcagaataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggttctgtgccgcagcacgcaaaatttagaattctacagactagctctatacgtagtgaggacccagatttagagaaactgaccaatatttatctccgcatttgtgtgtgtgtccaactctgtaggccaataaaccaacaagacaaatgaactgtgctccaca

SEQ ID NO: 34727 - DNA, 5863 bp, Homo sapiens
gtcagcggcggcggcggcggcggcagcggggccgggccggggccaggcgctgggggggccagggccggagctggagccggagccggagctggaggcgggcaaaaccggagcggccgggggcggccacggtgatgagccgggcctggcggacgcggcgccatcgcagtcagaaggaagaggcccagcagaagggactcgctgagccaccccccgccccactccatgttggctgtgctctcaggctggcaccatgcccccccctgcagaggtgacggacccgtcccatgcccccgccgtcctgcgccagctcaatgaacagcggctccgtggcctcttctgtgacgtcaccctcatagccggagacaccaagttccctgctcaccgcagcgtcctggctgcttcaagtcccttcttcagagaggccctgctcacttcagccccactaccccttccaccagctactgggggcgccgcacccaaccctgccaccaccacagctgcctcttcctcctcctcctcttcctcgtcttcttcctcttcttcctcctctgcttcttcttcttcttcctcttcctcttcctctccccctccagcctctccccctgcttcttccccaccccgggtcctggagttgccaggagtcccagcagctgcgttttctgatgtcctcaacttcatctacagcgcccggctcgcactgcctggtggtggaggggacggggcagctgtagcagagattggagctttggggcgccgtctgggcatctcccgccttcagggcctgggggagggaggtgatgcctgggtacctcctaccccagcccccatggccacctcgcagcctgaagaggacagctttgggcccgggcccaggccagctggggagtgggagggtgacagggctgaggcccaggcccctgacttgcagtgctccctgccccggcggcccctcccctgcccccagtgtggaaaaagcttcatccatcccaaacggctgcagacccatgaggcccagtgccgacgaggggccagcacgcgggggtctacagggctgggagctgggggcgctggccctggtggtcctgcaggggtggacgcctcagccctgcctccaccagtgggcttccgagggggccccgagcacgtggtgaaggtggtgggcggccacgtgctgtatgtgtgcgcggcctgcgagcgttcctacgtgaccctgtccagtctgaagagacacagcaatgtacactcgtggcggaggaagtacccctgccgctattgtgagaaagtgtttgctctggcggagtaccgcacgaagcatgaagtgtggcacacgggggagcgcaggtaccagtgcatcttctgttgggagacctttgtcacttactataacctgaagacccaccagcgagccttccacggcattagcccgggcctccttgccagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgccttgttctgaagctttctctaagcccttcccagttgcttcctagcacattccattctttgtggcccagggcctggaccagaccattgtgatacctgaccccgcccacctgggagtgtggctttgggtttcatccttccccagcgtgggtctctacgtccctgtttcccttgtatcaagacaccttcctcagcttccatgcctttggatcttccatgttcctccccatattcctggacttcggagatggcctctcccaagccaggtcaaggaggtttgggggagggttgcccctctgcccctctgttctgtggctgagcactttcccagtccagggcagggaaatattggccctatcttgacccccaaatccagtgagctccagattcttccaaggcaaaagaggtaagcagatcacacctctttctgcctctacatatggcctattctgggctagaccagatttgggggccaggagggaagaactccatatgggatggagaagggaatctactttctccctgtttttttttcctgatggtttctcccagactagaccaaatagccagaaaaatgataggggtcggatgggtgggtaagcccaggatttgcacatgaccttccatccttacctgtattcccatctccccagtgtcactcccctcaccaatcactccagatggttttgggggaaccattctactcttctggtgggctttggggtatccccaccaactttcccttcaaaatagcaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaaaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggttgaggatggaccggagaattggaacttcagaataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggttctgtgccgcagcacgcaaaatttagaattctacagactagctctatacgtagtgaggacccagatttagagaaactgaccaatatttatctccgcatttgtgtgtgtgtccaactctgtaggccaataaaccaacaagacaaatgaactgtgctcc

SEQ ID NO: 34728 - DNA, 931 bp, Homo sapiens
gatacccattgcgcgccggcctcaagatggccgccttctggcgtctccggcgctgttgaatggcgaaagctttattgttcccttcgggcaggagtgttcgtgtcctctatggcgctgtcaataaagaacggcagtttgaatcggtgctgaacagggcctgtcctcccaaagccaactctaaggagaggagaggaagagcagttcttggggcagagttgacgcaatggagctccccaactacagccggcagctgctgcagcagctgtacactctgtgcaaggagcagcagttctgtgattgcaccatctccattggtaccatttacttcagggctcacaagcttgtcctggctgctgccagcctcctgttcaaaaccctgctggataacacagataccatctccatcgatgcatctgtggtgagccccgaggagtttgcgctcttgttggaaatgatgtacacgggcaaactacctgtgggcaagcacaacttctccaaaatcatctccttagcagacagtctacagatgtttgatgtagctgttagctgcaaaaatcttctgaccagccttcttgctgccactccagggggccctgtgaaagctgagactgaggaagcagcccattcagtttcacaagagatgagtgtgaattctcccacagcccaggagagccagaggaatgcagaaaccccagcggagactcctactacagctgaagcttgttccccctcccctgctgtgcaaacctttagtgaggcaaagaagacaagcacagaaccaggatgtgaaaggaaacactaccagctgaattttcttctagaaaatgaaggtgtcttctcagatgcactcatggttacccaggatgttttaaaaaaactagaaatgtgttcaaactgttgtgtccctgttgaggctgtaccaatattctaa

SEQ ID NO: 34729 - DNA, 4445 bp, Homo sapiens
cggcagtttgaatcggtgctgaacagggcctgtcctcccaaagccaactctaaggagaggagaggaagagcagttcttggggcagagttgacgcaatggagctccccaactacagccggcagctgctgcagcagctgtacactctgtgcaaggagcagcagttctgtgattgcaccatctccattggtaccatttacttcagggctcacaagcttgtcctggctgctgccagcctcctgttcaaaaccctgctggataacacagataccatctccatcgatgcatctgtggtgagccccgaggagtttgcgctcttgttggaaatgatgtacacgggcaaactacctgtgggcaagcacaacttctccaaaatcatctccttagcagacagtctacagatgtttgatgtagctgttagctgcaaaaatcttctgaccagccttgtaaactgctcggttcagggtcaggtggtaagggatgtctctgcgccatcctcagagacattcagaaaggaaccagagaagcctcaagtagaaatcctttcatctgaaggtgctggagagcctcattcttccccagagcttgctgccactccagggggccctgtgaaagctgagactgaggaagcagcccattcagtttcacaagagatgagtgtgaattctcccacagcccaggagagccagaggaatgcagaaaccccagcggagactcctactacagctgaagcttgttccccctcccctgctgtgcaaacctttagtgaggcaaagaagacaagcacagaaccaggatgtgaaaggaaacactaccagctgaattttcttctagaaaatgaaggtgtcttctcagatgcactcatggttacccaggatgttttaaaaaaactagaaatgtgttcagaaattaaaggtccacagaaggaggtgattctgaattgctgtgagggcagaacacccaaggagacaatagaaaatttgttgcacagaatgactgaagagaagacgctgactgctgagggtttggtaaaactcctccaggctgtgaagacgactttcccaaacctgggccttctgctagagaagttgcagaaatcagccactttgccaagcaccacagtccaaccaagccctgatgattatgggactgagctattgagacgctatcatgaaaacctctctgagattttcacagacaaccagattttattaaagatgatctcacacatgacaagtttagcccctggagaaagagaggtcatggagaagcttgtgaaacgtgactctggttcaggtggtttcaattctctgatatcagcagttctagaaaagcagactctctctgccacagccatttggcaactgctgctggtggttcaggagacaaagacctgtccattggacctgctcatggaggaaatacgaagggagcctggtgccgatgctttcttccgggcagtgaccaccccagaacatgccactttagaaacaatcctgaggcataaccagttgatcttggaggccatccaacagaagattgagtacaagctctttacctcggaggaggagcacctggcagagactgtgaaagagattctgagcattccctctgagacagccagccctgaagcttccctgagagcagtgctgagcagagccatggaaaaatcagtcccggccattgaaatatgccacctcctgtgcagtgtccacaaatcttttccaggcctgcagcctgtcatgcaggagttggcatacattggtgtccttactaaggaagatggagagaaggaaacgtggaaggtgagtaataaatttcaccttgaagccaacaacaaagaagatgaaaaggcagccaaagaagacagccagcctggggaacagaatgatcaaggagagactggttccttgccaggacagcaagagaaagaggcttcagcctccccagaccctgccaagaagagcttcatctgtaaggcctgcgacaaaagcttccatttctactgccgcctaaaggtgcacatgaagcgctgccgggtggctaagagcaaacaggtgcagtgtaaggagtgcagtgagaccaaggattcaaagaaagagctggacaaacatcagctggaggcccatggtgcaggtggagagcccgatgcccccaagaagaagaagaagaggcttccagtgacatgtgacctctgtggcagagaatttgcccatgcctcaggcatgcagtaccataagctgacagagcacttcgatgagaagcctttctcctgtgaagagtgtggggcgaagtttgcagccaattccaccctgaagaaccaccttcgccttcacaccggggaccgcccgttcatgtgcaagcactgcctcatgaccttcacccaggcctccgccctggcctatcacaccaagaagaagcactcagaagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacaacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacgtggtgacccacgttggagggaagcccttcagctgcgggatctgcaacaaggcctaccagcaattgtctggtttgtggtaccacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcagatatgaagttccatgaatgtgaccagtgtaaggagctcttccccacgccagccttgctgcaggttcatgtcaagtgccagcattcagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtg

SEQ ID NO: 34730 - DNA, 8685 bp, Homo sapiens
cggcctcaagatggccgccttctggcgtctccggcgctgttgaatggcgaaagctttattgttcccttcgggcaggagtgttcgtgtcctctatggcgctgtcaataaagaacggcagtttgaatcggtgctgaacagggcctgtcctcccaaagccaactctaaggagaggagaggaagagcagttcttggggcagagttgacgcaatggagctccccaactacagccggcagctgctgcagcagctgtacactctgtgcaaggagcagcagttctgtgattgcaccatctccattggtaccatttacttcagggctcacaagcttgtcctggctgctgccagcctcctgttcaaaaccctgctggataacacagataccatctccatcgatgcatctgtggtgagccccgaggagtttgcgctcttgttggaaatgatgtacacgggcaaactacctgtgggcaagcacaacttctccaaaatcatctccttagcagacagtctacagatgtttgatgtagctgttagctgcaaaaatcttctgaccagccttgtaaactgctcggttcagggtcaggtggtaagggatgtctctgcgccatcctcagagacattcagaaaggaaccagagaagcctcaagtagaaatcctttcatctgaaggtgctggagagcctcattcttccccagagcttgctgccactccagggggccctgtgaaagctgagactgaggaagcagcccattcagtttcacaagagatgagtgtgaattctcccacagcccaggagagccagaggaatgcagaaaccccagcggagactcctactacagctgaagcttgttccccctcccctgctgtgcaaacctttagtgaggcaaagaagacaagcacagaaccaggatgtgaaaggaaacactaccagctgaattttcttctagaaaatgaaggtgtcttctcagatgcactcatggttacccaggatgttttaaaaaaactagaaatgtgttcagaaattaaaggtccacagaaggagatgatagtgaaatgtttcgagggtgaaggaggacattcagcattccagagaatcctgggtaaagtaagagaggaaagcctggatgttcaaactgttgtgtccctgttgaggctgtaccaatattctaatcctgcagtaaaaacagcactattagacaggaagccagaagatgtagacacagtgcagccaaaagggagcacagaggagggaaagaccttgtctgttctgttactagaacacaaagaggacctgatacagtgtgtaacacagctgagacctattatggagtccctggaaacagccaaggaggaattcctgactggcactgaaaaaagggtgattctgaattgctgtgagggcagaacacccaaggagacaatagaaaatttgttgcacagaatgactgaagagaagacgctgactgctgagggtttggtaaaactcctccaggctgtgaagacgactttcccaaacctgggccttctgctagagaagttgcagaaatcagccactttgccaagcaccacagtccaaccaagccctgatgattatgggactgagctattgagacgctatcatgaaaacctctctgagattttcacagacaaccagattttattaaagatgatctcacacatgacaagtttagcccctggagaaagagaggtcatggagaagcttgtgaaacgtgactctggttcaggtggtttcaattctctgatatcagcagttctagaaaagcagactctctctgccacagccatttggcaactgctgctggtggttcaggagacaaagacctgtccattggacctgctcatggaggaaatacgaagggagcctggtgccgatgctttcttccgggcagtgaccaccccagaacatgccactttagaaacaatcctgaggcataaccagttgatcttggaggccatccaacagaagattgagtacaagctctttacctcggaggaggagcacctggcagagactgtgaaagagattctgagcattccctctgagacagccagccctgaagcttccctgagagcagtgctgagcagagccatggaaaaatcagtcccggccattgaaatatgccacctcctgtgcagtgtccacaaatcttttccaggcctgcagcctgtcatgcaggagttggcatacattggtgtccttactaaggaagatggagagaaggaaacgtggaaggtgagtaataaatttcaccttgaagccaacaacaaagaagatgaaaaggcagccaaagaagacagccagcctggggaacagaatgatcaaggagagactggttccttgccaggacagcaagagaaagaggcttcagcctccccagaccctgccaagaagagcttcatctgtaaggcctgcgacaaaagcttccatttctactgccgcctaaaggtgcacatgaagcgctgccgggtggctaagagcaaacaggtgcagtgtaaggagtgcagtgagaccaaggattcaaagaaagagctggacaaacatcagctggaggcccatggtgcaggtggagagcccgatgcccccaagaagaagaagaagaggcttccagtgacatgtgacctctgtggcagagaatttgcccatgcctcaggcatgcagtaccataagctgacagagcacttcgatgagaagcctttctcctgtgaagagtgtggggcgaagtttgcagccaattccaccctgaagaaccaccttcgccttcacaccggggaccgcccgttcatgtgcaagcactgcctcatgaccttcacccaggcctccgccctggcctatcacaccaagaagaagcactcagaagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacaacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacgtggtgacccacgttggagggaagcccttcagctgcgggatctgcaacaaggcctaccagcaattgtctggtttgtggtaccacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcagatatgaagttccatgaatgtgaccagtgtaaggagctcttccccacgccagccttgctgcaggttcatgtcaagtgccagcattcagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagccaccactgctggccagtttttgtatttttttttttttttgtagagacagggtctcgccatgttgcccaggctggtttaaaactcctgagctcaagcagttctcccacctgggcctcccaaagtgctaggattacagacatgagccactacgcctggccaggtttctgttggagacccagattgtgacaagacatttgttttcttcggaatcaccagatttgcagcttactgtgccgagagtggactggctgccggggcccatcagatgccctctggcccatggcacactcagcagaaggcacaaacccagtgctggttctcatcaagaaagaggggaaggcccttcccgagtttactgtctgctctgagtgggctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagctgtcccgctgtctaactgacattgtgtgagatgcttactctctctgagctccctcctcctggctcccaactttattataaaatggggaaaatgattgtgcttgccctacagaattgtagtatgaattaaaagtctggatttaatgtatttaatatagaaaattttagcttttattaataaaagtttttggcatacaa

SEQ ID NO: 34731 - DNA, 1855 bp, Homo sapiens
cggcctcaagatggccgccttctggcgtctccggcgctgttgaatggcgaaagctttattgttcccttcgggcaggagtgttcgtgtcctctatggcgctgtcaataaagaacggcagtttgaatcggtgctgaacagcaaaagtttactgacccctgccctaaacacaaggagattggatcagtgttgtcattcagctattcctctcgtcggttcttctggagtgggaaaagagttaaaactgcgcgatgcaccgagagcactttagttgacagaacactctggcttcccttctggtcttactgactattcagagtttctcctgctttgaatagcgttggtaccatgcagccagtgctgcaatgaaccaggtgctttatttatattcatacaagtgttgttctactttatgacgacgctttataaggcctgtcctcccaaagccaactctaaggagaggagaggaagagcagttcttggggcagagttgacgcaatggagctccccaactacagccggcagctgctgcagcagctgtacactctgtgcaaggagcagcagttctgtgattgcaccatctccattggtaccatttacttcagggctcacaagcttgtcctggctgctgccagcctcctgttcaaaaccctgctggataacacagataccatctccatcgatgcatctgtggtgagccccgaggagtttgcgctcttgttggaaatgatgtacacgggcaaactacctgtgggcaagcacaacttctccaaaatcatctccttagcagacagtctacagatgtttgatgtagctgttagctgcaaaaatcttctgaccagccttgtaaactgctcggttcagggtcaggtggtaagggatgtctctgcgccatcctcagagacattcagaaaggaaccagagaagcctcaagtagaaatcctttcatctgaaggtgctggagagcctcattcttccccagagcttgctgccactccagggggccctgtgaaagctgagactgaggaagcagcccattcagtttcacaagagatgagtgtgaattctcccacagcccaggagagccagaggaatgcagaaaccccagcggagactcctactacagctgaagcttgttccccctcccctgctgtgcaaacctttagtgaggcaaagaagacaagcacagaaccaggatgtgaaaggaaacactaccagctgaattttcttctagaaaatgaaggtgtcttctcagatgcactcatggttacccaggatgttttaaaaaaactagaaatgtgttcagaaattaaaggtccacagaaggagatgatagtgaaatgtttcgagggtgaaggaggacattcagcattccagagaatcctgggtaaagtaagagaggaaagcctggatgttcaaactgttgtgtccctgttgaggctgtaccaatattctaatcctgcagtaaaaacagcactattagacaggaagccagaagatgtagacacagtgcagccaaaagggagcacagaggagggaaagaccttgtctgttctgttactagaacacaaagaggacctgatacagtgtgtaacacagctgagacctattatggagtccctggaaacagccaaggaggaattcctgactggcactgaaaaaagggtgattctgaattgctgtgagggcagaacacccaaggagacaatagaaaatttgttgcacagaatgactgaagagaagacgctgactgctgagggtttggtaaaactcctccaggctgtgaagacgactttcccaaacctgggccttctgctagagaagttgcagaaatcagccactttgccaagcaccacag

SEQ ID NO: 34732 - DNA, 8992 bp, Homo sapiens
gatacccattgcgcgccggcctcaagatggccgccttctggcgtctccggcgctgttgaatggcgaaagctttattgttcccttcgggcaggagtgttcgtgtcctctatggcgctgtcaataaagaacggcagtttgaatcggtgctgaacagcaaaagtttactgacccctgccctaaacacaaggagattggatcagtgttgtcattcagctattcctctcgtcggttcttctggagtgggaaaagagttaaaactgcgcgatgcaccgagagcactttagttgacagaacactctggcttcccttctggtcttactgactattcagagtttctcctgctttgaatagcgttggtaccatgcagccagtgctgcaatgaaccaggtgctttatttatattcatacaagtgttgttctactttatgacgacgctttataaggcctgtcctcccaaagccaactctaaggagaggagaggaagagcagttcttggggcagagttgacgcaatggagctccccaactacagccggcagctgctgcagcagctgtacactctgtgcaaggagcagcagttctgtgattgcaccatctccattggtaccatttacttcagggctcacaagcttgtcctggctgctgccagcctcctgttcaaaaccctgctggataacacagataccatctccatcgatgcatctgtggtgagccccgaggagtttgcgctcttgttggaaatgatgtacacgggcaaactacctgtgggcaagcacaacttctccaaaatcatctccttagcagacagtctacagatgtttgatgtagctgttagctgcaaaaatcttctgaccagccttgtaaactgctcggttcagggtcaggtggtaagggatgtctctgcgccatcctcagagacattcagaaaggaaccagagaagcctcaagtagaaatcctttcatctgaaggtgctggagagcctcattcttccccagagcttgctgccactccagggggccctgtgaaagctgagactgaggaagcagcccattcagtttcacaagagatgagtgtgaattctcccacagcccaggagagccagaggaatgcagaaaccccagcggagactcctactacagctgaagcttgttccccctcccctgctgtgcaaacctttagtgaggcaaagaagacaagcacagaaccaggatgtgaaaggaaacactaccagctgaattttcttctagaaaatgaaggtgtcttctcagatgcactcatggttacccaggatgttttaaaaaaactagaaatgtgttcagaaattaaaggtccacagaaggagatgatagtgaaatgtttcgagggtgaaggaggacattcagcattccagagaatcctgggtaaagtaagagaggaaagcctggatgttcaaactgttgtgtccctgttgaggctgtaccaatattctaatcctgcagtaaaaacagcactattagacaggaagccagaagatgtagacacagtgcagccaaaagggagcacagaggagggaaagaccttgtctgttctgttactagaacacaaagaggacctgatacagtgtgtaacacagctgagacctattatggagtccctggaaacagccaaggaggaattcctgactggcactgaaaaaagggtgattctgaattgctgtgagggcagaacacccaaggagacaatagaaaatttgttgcacagaatgactgaagagaagacgctgactgctgagggtttggtaaaactcctccaggctgtgaagacgactttcccaaacctgggccttctgctagagaagttgcagaaatcagccactttgccaagcaccacagtccaaccaagccctgatgattatgggactgagctattgagacgctatcatgaaaacctctctgagattttcacagacaaccagattttattaaagatgatctcacacatgacaagtttagcccctggagaaagagaggtcatggagaagcttgtgaaacgtgactctggttcaggtggtttcaattctctgatatcagcagttctagaaaagcagactctctctgccacagccatttggcaactgctgctggtggttcaggagacaaagacctgtccattggacctgctcatggaggaaatacgaagggagcctggtgccgatgctttcttccgggcagtgaccaccccagaacatgccactttagaaacaatcctgaggcataaccagttgatcttggaggccatccaacagaagattgagtacaagctctttacctcggaggaggagcacctggcagagactgtgaaagagattctgagcattccctctgagacagccagccctgaagcttccctgagagcagtgctgagcagagccatggaaaaatcagtcccggccattgaaatatgccacctcctgtgcagtgtccacaaatcttttccaggcctgcagcctgtcatgcaggagttggcatacattggtgtccttactaaggaagatggagagaaggaaacgtggaaggtgagtaataaatttcaccttgaagccaacaacaaagaagatgaaaaggcagccaaagaagacagccagcctggggaacagaatgatcaaggagagactggttccttgccaggacagcaagagaaagaggcttcagcctccccagaccctgccaagaagagcttcatctgtaaggcctgcgacaaaagcttccatttctactgccgcctaaaggtgcacatgaagcgctgccgggtggctaagagcaaacaggtgcagtgtaaggagtgcagtgagaccaaggattcaaagaaagagctggacaaacatcagctggaggcccatggtgcaggtggagagcccgatgcccccaagaagaagaagaagaggcttccagtgacatgtgacctctgtggcagagaatttgcccatgcctcaggcatgcagtaccataagctgacagagcacttcgatgagaagcctttctcctgtgaagagtgtggggcgaagtttgcagccaattccaccctgaagaaccaccttcgccttcacaccggggaccgcccgttcatgtgcaagcactgcctcatgaccttcacccaggcctccgccctggcctatcacaccaagaagaagcactcagaagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacaacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacgtggtgacccacgttggagggaagcccttcagctgcgggatctgcaacaaggcctaccagcaattgtctggtttgtggtaccacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcagatatgaagttccatgaatgtgaccagtgtaaggagctcttccccacgccagccttgctgcaggttcatgtcaagtgccagcattcagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagccaccactgctggccagtttttgtatttttttttttttttgtagagacagggtctcgccatgttgcccaggctggtttaaaactcctgagctcaagcagttctcccacctgggcctcccaaagtgctaggattacagacatgagccactacgcctggccaggtttctgttggagacccagattgtgacaagacatttgttttcttcggaatcaccagatttgcagcttactgtgccgagagtggactggctgccggggcccatcagatgccctctggcccatggcacactcagcagaaggcacaaacccagtgctggttctcatcaagaaagaggggaaggcccttcccgagtttactgtctgctctgagtgggctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagctgtcccgctgtctaactgacattgtgtgagatgcttactctctctgagctccctcctcctggctcccaactttattataaaatggggaaaatgattgtgcttgccctacagaattgtagtatgaattaaaagtctggatttaatgtatttaatatagaaaattttagcttttattaataaaagtttttggcatacaagtc

SEQ ID NO: 34733 - DNA, 3800 bp, Homo sapiens
tgaagttcaggagcgcccgggcggggacgcgcgcaggtttgcgcggctccggctcctgcgcctgagtcccgggacccgcccccgcggcggagctgctactgtttactttcgatcgagtttttcctgctcggggcaggtgcccgcggcggctctggacgggaggttgcgcgcgtcactcccgcgccgctctttccgcgctgcctgcagccgggaagggcgcttcgtgggcgcctccaggcgcgctgacgggcgtcccgtttgtgcccaggtgatgacggcggcggcatggagttccctgagcacggcggacggctgctgggccgcctgagacagcagcgcgagctgggcttcctatgcgactgcaccgtgctggtgggcgacgcgcgcttcccggcccaccgtgccgtgctggccgcgtgcagcgtctacttccatctcttctacagggaccggcccgcgggcagtcgcgacacggtgcggctcaacggcgacatcgtcacggcgcccgccttcggccgcctactggacttcatgtacgagggccgcctggacctgcgcagcctgcctgtggaggacgtcctggcagccgccagctacctgcacatgtatgacatcgtcaaggtctgcaagggcaggctccaggagaaggatcgaagtctggacccggggaaccctgcccctggggcagaacctgctcagccaccgtgcccctggcctgtctggaccgcggacctctgcccagctgcccgaaaggccaagctccccccgtttggggtcaaggctgccctccctcctcgagcatctgggcctcctccctgccaggtcccagaagagtcagaccaggccctggacctgtcgttgaagtctggcccaaggcaggagcgggtccacccaccgtgcgtcctccagacacccctctgcagccagaggcagccaggggcccagccactggtgaaggacgaacgggactcactgtccgaacaggaggagagcagcagctctaggagcccccacagtcccccgaagccacctcctgttcctgcagccaagggcctggtggtgggcttgcagccgctgcccctcagcggagagggcagccgggagctggagcttggtgcagggcgactggcgagtgaggacgagctggggcctggtgggcccctctgcatctgcccgttgtgcagcaagctgtttcccagctcccacgtgctgcagctgcacctcagtgcccacttccgtgagcgagacagcacccgggcccggctctcacccgacggcgtggcacccacctgcccgctctgtgggaagaccttctcgtgcacatacacactgaagaggcacgagcggacacactcgggtgagaagccctatacgtgtgtgcagtgtggcaaaagttttcagtactcccacaacctgagccggcacaccgtagtgcacactcgagagaagccgcatgcctgccggtggtgtgagcgccgtttcacgcagtccggggacctctaccgccacgtccgcaagtttcactgtggcctcgtcaagtcccttctggtgtgatgcatccctgtgggtcctgagggtggggtggaagggaagggatgggccctcccaggtgggacacagcatggggtgtgaagcctgaccaggtggaggtccctgcttgggccagatggctccaccctcctggcagagagaatgctgcctcttcctggaacttggcctcagactcggtaacttgggcagccttcctcccaccttgcctctcctttcccctcactctccaactcattccggcccccaggctgtgccctgcctaggctgtgacactatcttcctctcccgtcccctccagccaagttctgaggggtgtccaaccagcacctggctctgcccccgtttctccgtgtgagatggcacatccatctcccggcccgggactttcctgaccacctctctggcaggcttggggaggtcttcatgagcctggccccacgctaggtgaattattcacatgtcagaaaagttgttggtgtgcgtcccaatggggcgctgggagggaacaggacactcctggggagcggcagcaggaacccctgccaggaaggcctggggcacagtgagtgccagcaggggccatctgggcacagctggtgtctcggggtgggggggggggtgcagccccagcagggatcctaaggcagcaggagtagagccagctagaagctgagtggctgtggcatcattgtcactcgggtgggacgtgggtccatgagagcgtgcaattatgaccacactgtaactttgagcagagaaagtgggaatttggaactggattctctttagagccaggaagagcctcctgaggcggccagatgtctgctggtggccgcccagccacatgcttgtctgcctgagtgcaggtctaggaagcctctgggcatcccccagggtggggtctgggccgctgagctgtgtgctgctgctgggccaccgtgggccttaccttgacggtcactctgcctgctagggggtttccctggagctgtgggcatttccgtgcactgactgagcagaggcaagggctgccctgtccgccaggggcagggtttgcgggccttcctttccccacggcgaggcatgggtgaaagtggccatggcggcagggttaggggcaggtgaggagtgggagtcgcagcaccctaggggcctccatccgcagccttgggagactgacgctcctcgaacatgaatagaatgtggagaccacaacccccacacatgtcgttggttcaggtcgccctgctttgcctgcctaatggagcacatcttgctgccagaacctcactggcctctgggggtcggcaggtgcagagccacctggacgcctggagaccacctgggatgtttcctctgtgactgggaatggccttgacaacagagtccagccaagtctacgttattttctcatctcctgacaacactggatgtcatatttattagtcagcctggtctggagtgaaagaccgtccctagcgcatctcccacgcgccctgggctcctggtgtgctgggtgccagcctgggagcccagcgcttctgggtgatgccccagggctcagaggccctggatggctttggtctcgagacagctgggggaggggccctgcttctgattgtcctgggccccagcccccacctctgcaagggatcggtgtgatgtgctccataatcgggtggggggtgtgtgtgtgtgtgtgtgtgtgtgtatgtatgcatgcgtctggcacatggcaaggcccaagccaacccggcaccccgtagatgggcagctacactgccacccaagcacggagatgtggccgcggcactgggtcccccagtgggtcccatgggggaagaacttccctttgctggggtgggcagcctgccctgagctatcaacactggatttgttgtcttctgcacagctactgtgaagataacgtaaggagaagtggtcagttttcattttataactgacacagttgggacaaaatatatacgtgtacatatatttaagacactaattgtgtgggagagtttagtagaggcctgtgcagacacaaggcaaacagcgtcagcagcgtgggggtctcctgggccagctcggcacctgtgggtgctctgaccctgggggtggggacagctccgtgctaaccccagcagacagttgttggtgcacagtgtctaggaggcgtgggaatgggtgctgtcttcctcttttcacatcatggcgacagtaataaagcccacctccagtggaaa

SEQ ID NO: 34734 - DNA, 1411 bp, Homo sapiens
ccctccccgccggggcgcgctgcccgcagctccacgcgcgccagggccgccctggggagggcgcgcgcgcgagcggcgaccggagaggagctcggggcggcggaggtgatgacggcggcggcatggagttccctgagcacggcggacggctgctgggccgcctgagacagcagcgcgagctgggcttcctatgcgactgcaccgtgctggtgggcgacgcgcgcttcccggcccaccgtgccgtgctggccgcgtgcagcgtctacttccatctcttctacagggaccggcccgcgggcagtcgcgacacggtgcggctcaacggcgacatcgtcacggcgcccgccttcggccgcctactggacttcatgtacgagggccgcctggacctgcgcagcctgcctgtggaggacgtcctggcagccgccagctacctgcacatgtatgacatcgtcaaggtctgcaagggcaggctccaggagaaggatcgaagtctggacccggggaaccctgcccctggggcagaacctgctcagccaccgtgcccctggcctgtctggaccgcggacctctgcccagctgcccgaaaggccaagctccccccgtttggggtcaaggctgccctccctcctcgagcatctgggcctcctccctgccaggtcccagaagagtcagaccaggccctggacctgtcgttgaagtctggcccaaggcaggagcgggtccacccaccgtgcgtcctccagacacccctctgcagccagaggcagccaggggcccagccactggtgaaggacgaacgggactcactgtccgaacaggaggagagcagcagctctaggagcccccacagtcccccgaagccacctcctgttcctgcagccaagggcctggtggtgggcttgcagccgctgcccctcagcggagagggcagccgggagctggagcttggtgcagggcgactggcgagtgaggacgagctggggcctggtgggcccctctgcatctgcccgttgtgcagcaagctgtttcccagctcccacgtgctgcagctgcacctcagtgcccacttccgtgagcgagacagcacccgggcccggctctcacccgacggcgtggcacccacctgcccgctctgtgggaagaccttctcgtgcacatacacactgaagaggcacgagcggacacactcgggtgagaagccctatacgtgtgtgcagtgtggcaaaagttttcagtactcccacaacctgagccggcacaccgtagtgcacactcgagagaagccgcatgcctgccggtggtgtgagcgccgtttcacgcagtccggggacctctaccgccacgtccgcaagtttcactgtggcctcgtcaagtcccttctggtgtgatgcatccctgtgggtcctga

SEQ ID NO: 34735 - DNA, 5495 bp, Homo sapiens
tccgggtcccaaaagggttcgaggcctcttgccttcgctccgtaggagggagttctcttctggccctgggggccgcaggactgtccaggaatacagtttccaggtgagatcttacttgaaacaccggtagttctagcacagctaaaatggcatctacttgggctatccaggcccacatggaccaggatgaacctttggaagtaaagatagaggaagagaaatataccaccagacaggattgggacctgcgtaaaaacaacacccatagcagagaggtcttccgtcagtacttcagacagttctgctaccaggagacatctggtccccgtgaggctttgagccgactccgagaactttgccatcagtggctgaggccagagacccacaccaaagaacagattctggagctgctggtgctggagcagttcctgaccatcctacctgaggagctccaggcctgggtgcaggagcagcatccagagagtggggaggaggtggtgactgtgctggaggatttagagagagaactggatgaaccaggagagcaggtctcagtccacactggggaacaggaaatgttcttgcaggagacggtacgtctacgaaaagaaggagaacccagtatgtccctccagtccatgaaagcccagccaaagtatgaatctccagaacttgaatcccaacaggagcaagttttagatgttgagactggaaatgagtatgggaatttaaagcaagaagtttctgaagaaatggaaccacatgggaagacatccagtaaatttgaaaatgatatgtccaagtctgctaggtgtggagaaactcgtgaacctgaagaaataacagaagagccctctgcttgctccagagaagataaacaacctacctgtgatgaaaatggagtaagcctgactgagaactctgaccatactgaacatcagagaatctgtccaggagaagaatcttacggatgtgatgactgtggaaaagcttttagtcagcactcacacctcatagaacatcagaggatccatactggagatagaccctacaaatgcgaagaatgtggaaaagctttccgtgggagaactgtgcttattcgacacaaaataatacacactggagagaaaccgtataagtgtaatgaatgtggcaaagcctttggccggtggtcagctcttaaccaacatcagagacttcacacaggagaaaaacactatcactgtaatgactgtggcaaagcctttagtcagaaagcaggcctctttcaccatatcaagatccacacaagagacaaaccttatcagtgcactcagtgtaataaaagttttagtcggcgttccatacttactcagcatcaaggagttcataccggcgccaagccgtatgagtgcaacgagtgtggaaaagcctttgtttataactcatcccttgtttcccatcaggaaatccaccacaaagaaaaatgctatcagtgtaaggaatgtgggaaatccttcagtcagagtggccttattcagcatcagagaattcacactggggaaaaaccctacaaatgtgacgtatgtgaaaaagcctttattcaaaggacaagtcttacagaacatcagcgaattcacactggagaaagaccctataaatgtgataagtgtgggaaggcgtttactcaaagatcagtcctcacggaacatcagagaatccacactggagagaggccctacaagtgtgatgagtgtgggaatgccttccgaggaatcaccagcctcattcagcatcagagaatccacactggggagaagccctaccaatgtgatgagtgtggaaaagccttcagacagaggaagaagaccagctacaaggaaatacttctgaaaaatcactctgaaccccaagctggagtgaatcttctcctgagctctctcattccagaatggcaatcttgtttcaggagagatctctaatagtgactgatggtaaaggaagaaggctgtgcctagaacaaagaatcaggctggcaaagaaatcacaggtctttcctcaaactttaaattgctactctctggagatagctacctggactttacagagctgtcagaagacttgggaaggtttgccagcattggaaaaagccacttggacttcacagagctgtcagaagacttaggaagctttgccagtagttcctgagaccagaaatacatattatgaagcaggtgctggaacaggccctggcccctacttgtgaagctgcagatataggtaagataatatcatccagaatgtggagacgaggcaatcgatgatgctggaaaagttgaagagagagtttgaatgaaggacaaaccaccgatgggaaagcttgggaggatcacttatagcttgactagcaaaaggctttgggaataggatagaaagcagcaaacctgaactttaggatccaccagatgtctctggagccataacccaacatttcccataaatagtaggttttaattctcctgttatttaggtgcatctctgggacctcctctttctatattgggttttttgtttgttgggtgttttaacttaggatttagcttcaaattccatttcccaagaccaattttatcacattgcctttaggtctcaggctaaatgatataacaagatatgcttttggcaaagatagtaccttggaatgaaaggtttcagatcaaacctaagatcctaccttagtttacctctcagtgttattgccttttgatatggaaagctgatgagagagcatctctggagagaaagaagaggagagcctcacgggaagcttttagaacttttagtagcatcctctccccagaaaacttgtctctactcatctccttctcattatctacctgattcgttaagtaggaaatctcagccatatttgtaggggattggggttttgttttttttgacccacttaactcctttagcttcagagtgttgctttcttacattttagacatgaatattacctagaaaatttatttccccactgttaattttccagtttattgatttccccacatcagattagtgtgtattttgaaactggtttagctattgtttcaagttaactttgatcatatcccgttgtttactgatccactcaacaaatatttattgaacattctgtaggtttatagtagtagccaagatacttaaagtgagtagaaatagtccttttaactgtccttaacaaattaaactttctcttggtttcatgatattccttgtttctcagctttggattcaaactgatcttctcttttttgattatactttcctgatttcttttattgtcacatttttgtgaaaagtcttccatgcacttccagtctctttctgcctagctgtctcttctcacccaaattggacccccctactcctaccctgccacgtgccttcacaaaaatgagatgcttgtttagagacttagaaaaggcatgcactttaggtaaaagtggattttatttttaatcactgtaccctatcataaatctcatttcagaagagacaactgacatttgaattgtctgtgcattttgttttagatggtgttactgagaaggaaactaaggacttggctccaaaacaaaacaaaacaaaatctggagatgctgaattttgttggggggaatgtctgtagaactgcaacatcaatgcagtaagtgtagtaaaagctttagtttatggtgagtcattactcagcatcatggagtccacgatgaagagaatctcttttcaatctgtgcaatcaacaagtttttgaaaggcttttgtttatagtggaaccctcttttccccctagaagaaccaccacaaggaaaaatgctgtcaccataaggaatgtgggaaagttttcagccacatggccttatttgacttcaaagaatccacatgagagagagactgcataaatgtaataactgaggaggcctttgttcagcaaagaaaccttatacaaactcgtataaagaatgtaggaagaccttcacccagaagccaggactgactgtgcaccagagaatctgcacaataaacatgatgaatgtggagatgcttgcttcagcattggagaattcacagtaaagggaaaccctgccagtgtgatgagtacggaaaagtcttcagaggttggaacttgggaaaaatcagtgagtgaattcatattagagaggctcttataaatgagaggattgtggaaacttgtatagacagagatcagacctcaacaagggagcctccacagtattgaaaagttaatataattaatgtaagtgggcaagttgtatggggaatgggtagtctaaattgctcattttagccagtaaaaacattaaattagtttcttagatcaagaaaaggaaatgttagaagttatttttcccttccagaggggtctatatgtgtaagcaaccaggacttttgaaataagttgcatctctggatttgtgatctgtctcctggatgattatctctgttttgggagacaggtattttttcttcatgcctgctctagtctcatctcatatctttaattcattcagcaagtatacacaatagtattatcgtctactgtttgttgtaaatatatatatattattttctttttggtctgagtaggcttgtattggtaccctaggacataaaaatcacatatatcatgtttcagtaaatgcagtgaaaggaactatattattaaattgctgggaatttctgtaaatttgagactacctttatattctccaacacaagaccgtgtaggtgtcccttcagagagtatatttttctagcttggcttctttattttctttatttttttgagatggagtcttgctcctgtcgcccaggctggagtgcaatggcacgatctcggctcactgcaacctccgcctcccaggttcaagtgattctcctgtctcagtctcccgagtagctgggattacaggcacttgccaccattcccagctaatttttgtatttttagtagagacggggtttcaccatgttggccaggctggtctcgaactcctgaccttgtgatctgcccaccttggcctcccaaagttcagggattacaggcatgagccaccatgcccggctgtttttttaagatagaaaaatatacttcatgtatagcctattgacagataatgactgatattttttcttatagataacacataataaacattgtgaagactaataagtaacttgcttattcttttcagttctaaaacctgtaggaaagaatctttagaagctgtcaacaagttgataatgtagcccaatctctacccatgataggagagtaaggcttatatattttatagtagggcactaaatacaggaaccatgtatttaaaaactttttagtgattatctcagaattctaggtgtccctctgctgtacatccctaaattttttgcataggtattattaataaattcattattttcaaagatgg

SEQ ID NO: 34736 - DNA, 3909 bp, Homo sapiens
gggtcccaaaagggttcgaggcctcttgccttcgctccgtaggagggagttctcttctggccctgggggccgcaggactgtccaggaatacagtttccaggtgagatcttacttgaaacaccggtagttctagcacagctaaaatggcatctacttgggctatccaggcccacatggaccaggatgaacctttggaagtaaagatagaggaagagaaatataccaccagacaggattgggacctgcgtaaaaacaacacccatagcagagaggtcttccgtcagtacttcagacagttctgctaccaggagacatctggtccccgtgaggctttgagccgactccgagaactttgccatcagtggctgaggccagagacccacaccaaagaacagattctggagctgctggtgctggagcagttcctgaccatcctacctgaggagctccaggcctgggtgcaggagcagcatccagagagtggggaggaggtggtgactgtgctggaggatttagagagagaactggatgaaccaggagagcaggtctcagtccacactggggaacaggaaatgttcttgcaggagacggtacgtctacgaaaagaaggagaacccagtatgtccctccagtccatgaaagcccagccaaagtatgaatctccagaacttgaatcccaacaggagcaagttttagatgttgagactggaaatgagtatgggaatttaaagcaagaagtttctgaagaaatggaaccacatgggaagacatccagtaaatttgaaaatgatatgtccaagtctgctaggtgtggagaaactcgtgaacctgaagaaataacagaagagccctctgcttgctccagagaagataaacaacctacctgtgatgaaaatggagtaagcctgactgagaactctgaccatactgaacatcagagaatctgtccaggagaagaatcttacggatgtgatgactgtggaaaagcttttagtcagcactcacacctcatagaacatcagaggatccatactggagatagaccctacaaatgcgaagaatgtggaaaagctttccgtgggagaactgtgcttattcgacacaaaataatacacactggagagaaaccgtataagtgtaatgaatgtggcaaagcctttggccggtggtcagctcttaaccaacatcagagacttcacacaggagaaaaacactatcactgtaatgactgtggcaaagcctttagtcagaaagcaggcctctttcaccatatcaagatccacacaagagacaaaccttatcagtgcactcagtgtaataaaagttttagtcggcgttccatacttactcagcatcaaggagttcataccggcgccaagccgtatgagtgcaacgagtgtggaaaagcctttgtttataactcatcccttgtttcccatcaggaaatccaccacaaagaaaaatgctatcagtgtaaggaatgtgggaaatccttcagtcagagtggccttattcagcatcagagaattcacactggggaaaaaccctacaaatgtgacgtatgtgaaaaagcctttattcaaaggacaagtcttacagaacatcagcgaattcacactggagaaagaccctataaatgtgataagtgtgggaaggcgtttactcaaagatcagtcctcacggaacatcagagaatccacactggagagaggccctacaagtgtgatgagtgtgggaatgccttccgaggaatcaccagcctcattcagcatcagagaatccacactggggagaagccctaccaatgtgatgagtgtggaaaagccttcagacagaggaagaagaccagctacaaggaaatacttctgaaaaatcactctgaaccccaagctggagtgaatcttctcctgagctctctcattccagaatggcaatcttgtttcaggagagatctctaatagtgactgatggtaaaggaagaaggctgtgcctagaacaaagaatcaggctggcaaagaaatcacaggtctttcctcaaactttaaattgctactctctggagatagctacctggactttacagagctgtcagaagacttgggaaggtttgccagcattggaaaaagccacttggacttcacagagctgtcagaagacttaggaagctttgccagtagttcctgagaccagaaatacatattatgaagcaggtgctggaacaggccctggcccctacttgtgaagctgcagatatagatggtgttactgagaaggaaactaaggacttggctccaaaacaaaacaaaacaaaatctggagatgctgaattttgttggggggaatgtctgtagaactgcaacatcaatgcagtaagtgtagtaaaagctttagtttatggtgagtcattactcagcatcatggagtccacgatgaagagaatctcttttcaatctgtgcaatcaacaagtttttgaaaggcttttgtttatagtggaaccctcttttccccctagaagaaccaccacaaggaaaaatgctgtcaccataaggaatgtgggaaagttttcagccacatggccttatttgacttcaaagaatccacatgagagagagactgcataaatgtaataactgaggaggcctttgttcagcaaagaaaccttatacaaactcgtataaagaatgtaggaagaccttcacccagaagccaggactgactgtgcaccagagaatctgcacaataaacatgatgaatgtggagatgcttgcttcagcattggagaattcacagtaaagggaaaccctgccagtgtgatgagtacggaaaagtcttcagaggttggaacttgggaaaaatcagtgagtgaattcatattagagaggctcttataaatgagaggattgtggaaacttgtatagacagagatcagacctcaacaagggagcctccacagtattgaaaagttaatataattaatgtaagtgggcaagttgtatggggaatgggtagtctaaattgctcattttagccagtaaaaacattaaattagtttcttagatcaagaaaaggaaatgttagaagttatttttcccttccagaggggtctatatgtgtaagcaaccaggacttttgaaataagttgcatctctggatttgtgatctgtctcctggatgattatctctgttttgggagacaggtattttttcttcatgcctgctctagtctcatctcatatctttaattcattcagcaagtatacacaatagtattatcgtctactgtttgttgtaaatatatatatattattttctttttggtctgagtaggcttgtattggtaccctaggacataaaaatcacatatatcatgtttcagtaaatgcagtgaaaggaactatattattaaattgctgggaatttctgtaaatttgagactacctttatattctccaacacaagaccgtgtaggtgtcccttcagagagtatatttttctagcttggcttctttattttctttatttttttgagatggagtcttgctcctgtcgcccaggctggagtgcaatggcacgatctcggctcactgcaacctccgcctcccaggttcaagtgattctcctgtctcagtctcccgagtagctgggattacaggcacttgccaccattcccagctaatttttgtatttttagtagagacggggtttcaccatgttggccaggctggtctcgaactcctgaccttgtgatctgcccaccttggcctcccaaagttcagggattacaggcatgagccaccatgcccggctgtttttttaagatagaaaaatatacttcatgtatagcctattgacagataatgactgatattttttcttatagataacacataataaacattgtgaagact

SEQ ID NO: 34737 - DNA, 4643 bp, Homo sapiens
gaggtgtgctgggagctgtggtccgggtcggcgggcgcgcaagttggctagtctctgcggccacctccggaagggtccgccggctgtgctggtgaggcccagttccaaggctccggcatcctgtgtctcactgagcactgctgcccgatggccatccccaagcactccctgagcccagtgccgtgggaagaggacagcttccttcaagtgaaggtggaggaggaagaggaagccagcctctcccagggcggagaatccagccatgaccacattgctcactctgaggctgcacgcctgcgcttccggcacttccgctatgaggaggcatctggtccacacgaggccctggcccacctccgagcgctgtgctgtcagtggctgcagcccgaggcgcactccaaggagcagatactggagctgctggtgctggagcagttcctgggtgcgctgcccccagagatccaagcctgggtgggagcccagagtcccaagagcggagaggaagccgctgtgctggtggaggatctgactcaggtgctggacaagagaggatgggatccaggagccgagcccacagaggcaagctgcaagcagagtgacctgggagagtcagagccatcaaatgtcactgagaccctcatgggaggtgtttcccttggacccgcctttgtcaaggcatgtgaacctgagggcagctcagagaggtctggactatcaggggagatctggacaaagtctgtcacccaacagatccacttcaagaaaacttcagggccttacaaggatgtccccacagaccagcgtggccgtgaatctggtgcctcgaggaacagttctagtgcgtggccaaacctcacctcccaagagaagcctccttcagaagacaaatttgatctggtggatgcttatgggacagagcctccatacacctactcagggaagaggtcctccaagtgtcgcgagtgtaggaagatgttccagagtgcttcggcgctcgaggcacaccagaagacccattctcggaagaccccatatgcctgcagcgagtgtgggaaagccttcagccggagcactcacctcgcccagcaccaggttgtccacacaggggcgaagccccatgagtgtaaggaatgtgggaaggccttcagccgagtcacccacctgactcagcaccaaaggattcatactggagagaaaccctacaaatgtggggaatgtggtaaaaccttcagccgcagcactcacctcacccagcaccagcgggtgcacacgggggagcggccctacgagtgtgacgcgtgtgggaaagccttcagccagagcacgcacctgactcaacaccagcgcatccacaccggggagaagccctacaagtgtgacgcgtgtggccgagccttcagcgactgctcagccctgatccgacatctgagaatccactctggagagaagccatatcagtgtaaggtttgtccgaaggcctttgcacagagctcctccctcattgagcaccagaggatccacacgggagagaagccttataagtgcagcgactgtgggaaggccttcagtcgtagctcagccctgatggttcacttgcggatccacatcacggtgctgcaatgaccggaagtcgcccctgggggcgtagcacagcgtcttctcggaggctcgaggtctaagagaaacgctgagttcctgaagagccacagacagggtgggtgattgatgagttgtcaaaatgataggtgcctgagggcagactcgggctgtctaggaaccactctgcatttgaggaaccctgatgagcacaaggtgattcaggccagctggagaagcttccagaagggccctgcactgctaccctctatttcccactcagggctgtcccagagagaaggcagccgaactgaggatttagactggttctgagggccagggcaaatgaaggcgcatgtctctcagaactcagcgtcccaagacgctctgggcgggccaactgtagcttgttctcatgtggttcttcttgcctgcttttctgctgcttagcccagaacggacacctgccatgcccacctctgtgccttggcacctactatttccactccagactattttgtgcctaactgcaaggctgacttttgagactgcctcttccacgatgccttttctacactctgcctctctcatggtttcctgtcgtaatcagtggtgctgcttgacacctgcccagcatgttcctgtctctccttttccttccacatcccaccagtcaccagcgctattgttttaacctaaagcttatctgtaattcacctccttttccaccactgctaccttatgtgagccctcattgcctcttgcctggattatagccggggtctccttcctgaccacttcctgcctttattctctgcccctgtatcactctccaggggactcttgatattacttagatctgactgtgtcactccaaggtggaaagctctccaacccatcttctacagcacagcttcctgaacagggtataagtatgctgagatgcaggctgctctgggccccgagcaacctctccagttatcctcatatgcatgtatgaatactgtcatttttctgtgcgtgcagtgaaaatggcctcatctcataccatggctccaccttccatacaccagccacacggaactactgtggtccctgaaggagccatacattttcccacttatgtgcctttgtacctgtgcctggaaccctcctcttctttttctttttcttttcttttctttttttttttttgagatggagtctcgctctgtcgcccaggctggagtgcagtggcgcgatctcggctcactgcaagctctgcctcccgggttcatgccattctcctgcctcagcctcccaagtagctgggactacaggcgcctgccaccacgcccagctagtttttttttttttttgtatttttagtagagatggagtttcaccatgttagccaggatggtctcgatctcctgacctcgtgatccacccgcctcggcctcccaaagtgctgggattacaggcgtgagccaccgcacctggccctcctttttcatctaaggtgtttcaaatgttgcccaaagaaacctccctgctctccgggagcagacttcagcttgccctctctgcttccagagcacctcctagatacctctcttacaactcctgccaccttgttttacttatttgctccttgtagagctgccttttccaaggataccataaactcctgagagcaggggccatgtcttactctcagtatctacaacacacaagactcagtaggccctgactgatgtctcttacatgaatgtgactggtgcccccaggaggcagtcaccgtgctgtctctgccccacattgtccttatgtatgtttacatggatgtctccccagcagcttgaaccctggagagcaagaataatctgattttcctgggggccagcacccaaataagcctggcatgcagtggcctcaataaaatgtgactgtattgagtcattttctagggccccagatcccctggtgtcatggacttagtctttgccagcattctgtccatgtgttctctggtcttctctcacaatgctgcatccctgtcccatttttagggtccctgtctatcactggatgctgcagcttctgttcattactgttagtgtatcattcttcatgcctctgtttctgtgatggtctcatcatatgtgaaccatttgacctggcgtattgtgtactagtcaccgtcaccatctctccatatgtatctccctgtatttcgggcccattccctctatgtcaagagtaaatagaggcacagagactgatgagaaacgttcataacatgaaggtaagactcagggagacagagactttgtggaagtatctctgagggagtcccagacacaggcagagagggccacatatcgtgtgccagaggctgagagactgagagggatgacaggcttaggggaaaactcagagaggagagatgcacattcctagtgaaattgcacaggcttccagcatgctggagggaacagaaaaggcatgggcctgaattcaggctgcagagcctgactcctccctgtggctacttttgggacctaagataagtgactttcctgaacctccatgacctcctcatatgtaaaccagggacaggacccaccttgtgtagtgcctgacccaaagcctggccctgcacactgtctctgactcacagcaatcatcagcacctctctttgcctcctacttgctcagtctctgtcacaagaactggatctccatccccttgatgctctgagcatcttcacccatttggtcgttgagacatatctgtccatgtctgtctaaaaggggaggagatgagggagaaaaaagggaatctactcagagcctgtgtgtgctgcccagtctaccaaataatttatatacatctcagtcctcacacaaccatccctgttttatagaggaggaagtggcttagagaatgtaactgaccaaagtcacactgccaggaactggaagcactaggatttgacagcatatccaaatatgtcagcaatttcaataaacatgactgtactcaacaaaccaagtgtaaagac

SEQ ID NO: 34738 - DNA, 2245 bp, Homo sapiens
ccttgtaattcataaatctctgaaaacttaaaagtttgagcaaaagtttgtcatgtttctatgagtaatttataataaaacttgatcagaatttgtgagactaacgtttgtctttatattttccttttttttttttttttttttgagacacagtctcgctctgtcgtccaggctggagtgccgtggcgtaatctcggctcactgcaacctctgcctcctggattcaaacaattcttctgcctcagcctcctgagtagctgggattacaggaccagtgatggtatagaacactgtattagagacatggagctggggctggatgaagattccatcagtaattcaatcaacagacaagtgttatccaatcacgtctttaaatcaatcactgacatggagctggggctggatgaagattccatcagtaattcaatcaacagacaagtgttatccaatcacgtctttaaatcaatcactgatcccagcccctataaaagggagcagccttaggaggcacatcagataaacccagtgtggaaagctagtcacacatcagctcagtgttcggcccgggattacccagtcaaccaaggagcttgcagttttaaagaatccaccaactgttgaaacaaatccctagagacacaaggcaagagactgaatcatcaaagtaaagtctctctgagaattattgctaagaatggctttagatctaagaaccatatttcagtgtgaaccatccgagaataatcttggatcagaaaattcagcgtttcaacaaagccaaggacctgctgttcagagagaagaagggatttctgagttctcaagaatggtgctcaattcatttcaagacagcaataattcatatgcaaggcaggaattgcaaagactttataggatctttcactcatggctgcaaccagaaaagcacagcaaggatgaaattatttctctattagtcctggagcagtttatgattggtggccactgcaatgacaaagccagtgtgaaagagaaatggaaatcaagtggcaaaaacttggagagattcatagaagacctgactgatgacagcataaatccacctgccttagtccacgtccacatgcagggacaggaagctctcttttctgaggatatgcccttaagagatgtcattgttcatctcacaaaacaagtgaatgcccaaaccacaagagaagcaaacatggggacaccctcccagacttcccaagatacttccttagaaacaggacaaggatatgaagatgaacaagatggctggaacagttcttcgaaaactactcgagtaaatgaaaatattactaatcaaggcaatcaaatagtttccctaatcatcatccaggaagagaacggtcctaggcctgaagagggaggtgtttcttctgacaacccatacaactcaaaaagagcagagctagtcactgctagatctcaggaagggtccataaatggaatcactttccaaggtgtccctatggtgatgggagcagggtgtatctctcaaccagagcagtcctcccctgagtctgcccttacccaccagagcaatgagggaaattccacatgtgaggtacatcagaaaggatcccatggagtccaaaaatcatacaaatgtgaagaatgccccaaggtctttaagtatctctgtcacttattagctcaccagagaagacacaggaatgagaggccatttgtttgtcccgagtgtcaaaaaggcttcttccagatatcagacctacgggtgcatcagataattcacacaggaaagaagcctttcacatgcagcatgtgtaaaaagtccttcagccacaaaaccaacctgcggtctcatgagagaatccacacaggagaaaagccttatacatgtcccttttgtaagacaagctaccgccagtcatccacataccaccgccatatgaggactcatgagaaaattaccctgccaagtgttccctccacaccagaagcttcctaagctgctggtctgataatgtgtataaatatgtatgcaagtatgtatattcctatagtatttatctacttaggatataagatataatctcctgattatgctttcaatttattgtcttgcttcattaaaatgtaaggctaaggagagcatggaatttgtcagttttgttcactaaagtattccaagtggttgggaaagtggaacatttccaagaaccaataaatttctgttgaataaatgaatgaatcc

SEQ ID NO: 34739 - DNA, 5015 bp, Homo sapiens
ggacggcagcggccaagcaagaagaaagacgtggcagcaagcgggagtcggggatagtgtcatcggttcggtaaagtttctgttctctgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcgatttggggatattccctgcccaaaaaattcctggaaaattgactagtattaagtctatggaagatggagttttttttcatgatcctttaactctcaagttcatctttaaatgaactctttttttttgttttttttttgttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcctttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcagcttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 34740 - DNA, 4365 bp, Homo sapiens
ctgcaacctccacctcccgggttcaagaagtttccctaccttaggctcctgagtagctgggactacaggattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcctttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcagcttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtagg

SEQ ID NO: 34741 - DNA, 3004 bp, Homo sapiens
ggacgacggacggcagcggccaagcaagaagaaagacgtggcagcaagcgggagtcggggatagtgtcatcggttcgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcgatttggggatattccctgcccaaaaaattcctggaaaattgactagtattaagtgcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaa

SEQ ID NO: 34742 - DNA, 3451 bp, Homo sapiens
ttttctgctagtgctgctgctgctgggaggacgacggacggcagcggccaagcaagaagaaagacgtggcagcaagcgggagtcggggatagtgtcatcggttcggtaaagtttctgttctctgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttaggatttggggatattccctgcccaaaaaattcctggaaaattgactagtattaagtctatggaagatggagttttttttcatgatcctttaactctcaagttcatctttaaatgaactctttttttttgttttttttttgttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacacttt

SEQ ID NO: 34743 - DNA, 682 bp, Homo sapiens
gacgctggcagtcttggttttctgctagtgctgctgctgctgggaggacgacggacggcagcggccaagcaagaagaaagacgtggcagcaagcgggagtcggggatagtgtcatcggttcggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttaggatttggggatattccctgcccaaaaaattcctggaaaattgactagtattaagtgcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgc

SEQ ID NO: 34744 - DNA, 1892 bp, Homo sapiens
gacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacag

SEQ ID NO: 34745 - DNA, 2763 bp, Homo sapiens
agtgctgctgctgctgggaggacgacggacggcagcggccaagcaagaagaaagacgtggcagcaagcgggagtcggggatagtgtcatcggttcggtaaagtttctgttctctggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagact

SEQ ID NO: 34746 - DNA, 7979 bp, Homo sapiens
atgttagtggctgccaggaaaacttgtcatcattttagtcattcggtcaaggcccgtcagatactgcaagagttccaaaatgatcaccaacttccatggaagaatttgaagcaggacgaaactggccattggatttctactttttatatgttaaaatggctcttggagcattgctactcagttcaccatagtcttggtagagccagtggagttgtgctcacctcccttcagtggactctaatgacttatgtttgtgatattcttaagccatttgaggaggctacccagaaagtgagcgtgaagaccgcaggattgaatcaggtgctacccctaatccatcatctactcctttccctgcagaaactcagagaagattttcaagtcagaggtattactcaggccctcaatctggtggatagtttatctctgaaacttgaaacagataccctactaagtgccatgcttaaatccaagccctgtatcttggctactttgttagatccttgctttaaaaacagtttggaagacttttttcctcaaggtgctgatttagaaacttataagcagttccttgcagaagaggtctgtaattatatggaatcttcaccagagatctgccaaattccaacttcagaagcttcttgtccctcagttacagtgggagctgattcatttacctcatctctaaaagaaggcacctccagttcaggttctgttgatagctcagctgtagacaatgttgcccttggaagcaaaagcttcatgttcccttctgctgtagcagttgtggatgagtacttcaaagagaagtattcagagttctcaggaggtgatgaccctttaatttactggcagaggaagataagcatatggccggctttgacccaggttgccatccagtatctaagttgccccatgtgtagttggcaatctgaatgtatctttactaaaaatagccactttcatccaaaacagatcatgagcctggactttgacaatatagaacaactgatgtttctgaaaatgaacttgaaaaatgttaactacgattattctacgttggttctgagctgggatcctgagcagaatgaagttgttcaaagcagtgaaaaagaaatactgccttaatttctttttctccatttaaaatgggcaactttttgctgtgttactgtatcttaatagctgtagttgttaaatataatcattatctttataaacacatctggggaaacctgaaatcacacaagggctgaaaattcctcagaggcaatataattttgataaaatgaagattaaagatttcatagctataactgtggcgctagcacttgaaaattttgcttataccaatgagagagaagatatttttaattaaaaaaaatatagtgcagcattgaaaggccttaggctttcttcctggtagattgaactagtaattggttttaagtaaaacttcccccaccatgggaaattttattgctctgaaatcaacgaaatgagaaaaaagtacactggctggcattcctcctgcccctgtttttctgtttccttaaaaaccctgatgcttaattacaacttggcaaaaagaaaacccgtgaaattgttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttcctttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgattttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggagttttttttcatgatcctttaactctcaagttcatctttaaatgaactctttttttttgttttttttttgttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggtgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcctttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcagcttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtagg

SEQ ID NO: 34747 - DNA, 3046 bp, Homo sapiens
ggaagtggagcattggcatgaagtggctcctagtggctgcttggcgcacgccagctgccctcctctgactccagtggcacctgggggcctggcctcactgacgggagaacattggcgtgaaggctgctggcgactgggccagcattcattgtgaagaccggagggacacaccctgctgctcatgtctgcagggctctgagaggaggaagcctggggcaggacctgcgccagtggccgctgggcacagcatggagcaccccagcaagatggaattcttccagaagctgggctatgaccgggaggatgtgctccgggtgttgggcaagctgggcgagggcgccctggtcaacgacgtgctgcaggagcttatccgcacgggcagccgcccgggtgccctggagcacccggctgcacccaggctagtgcctcggggctcctgtggggtcccggactctgcccagcgtggcccggggacagccctggaagaggacttcagaaccctggccagttctctgcgacccatagtgattgatggcagcaacgtggcgatgagccatggaaataaagaaaccttctcttgccggggaatcaagctggctgttgactggttcagggacagaggacacacctacatcaaagtttttgttccatcctggaggaaggacccaccaagagctgacacccctatcagagagcagcacgtgctggcggagctggagcggcaggcggtgctggtgtacacgccgtcccgcaaggtgcacggcaagcgcctggtctgctacgacgaccgctacatcgtgaaggtggcctacgagcaggacggcgtcatcgtctccaacgacaactaccgggacctgcagagcgagaaccccgagtggaagtggttcatcgagcagaggctgctcatgttctccttcgtcaacgaccggttcatgccgcctgatgaccccctgggccgccatggaccctccctgagcaacttcctgagcaggaagccgaagcccccagagccatcctggcagcattgtccttatggcaagaaatgcacctatggcatcaagtgcaagttctaccacccggagaggccgcaccacgcgcaactggcggtggccgacgagctccgcgccaagacaggggcccggcctggcgcgggcgccgaggagcagcggccaccgagagccccgggcggctccgcaggagcccgggcggccccccgggaaccatttgcgcacagcctcccgccggcgcgggggtccccggacctggccgccctgcgagggagcttctctcggctggccttcagcgacgacctggggcccctggggccgcctctcccggtccccgcctgcagcctcacgccccgactgggcgggcccgactgggtgtccgcgggcggccgggtgccaggcccgctcagcctccctagcccggagagccagttctccccgggcgacctcccgcctccgcccggcctgcagctccagccgcggggcgaacaccgccctagggacctgcacggcgacttgctttccccgcgcaggccacccgacgacccgtgggcccgtccaccccgctccgaccgcttccctgggcgctccgtctgggcggagccggcctggggcgacggcgccactgggggactttcagtgtacgcgaccgaggacgacgagggggacgcgcgcgcccgggctcgcatcgcgctctacagcgtcttcccgcgtgaccaggtggaccgcgtgatggccgcgttcccggagctctcagacctcgccaggctcatcctcctggtacagagatgccagagcgcgggggcgcccctgggcaagccctaagggaccaacacgcacttgcagggaatggcccagcctcgccttgcgtcttggacgggtggacctgtggttgccagcctggacctgagtgggcccatcatggtgcccccttttctttaaagatggtcagggaagcctgcttcctcctcctgagcggggttgtgggggcctggtggcacttggtgatcctcactgaggccggggcctgctgcggggaggtccacccacttccgtggagggaatgattttccatgtgcacggagactgcgggtccaagctgcagtagaacccacaagtgggtcacaaaatcaatttagtgggtcaccaccacaaacacagtggactgggacagggcaaagcgcaccctgtgccatcaggctgagtctgaactcttgttacctatcctgtgtccccacccccttggcagccatgtaactaacctcaatgtgggtcgtagtcagaagtttaaaaaagactatgaatgctcttgaatttcattgcttcaggtaatgtttgaaatatgtagtcaggtggccaggggaggtttgctatctggaagttttcatgttagctattgctaaccccacccgcaagggcagcccagcctccaggtgtgggctctcctgtgctctgaattgtgtggctgtcctatgctggggacaagtggtaggagcgctttgtcccagggccaccttctggggccttcacacacatacccccaccacacaaacacacacacacacacacacacacacacacagtctatcatacatgtacatactcacacacaccacacagacacatactgtttggctaagggttaagtatctccaatattttattagccatccatcatggcagtttccagaataggctttctactgtaccagctgagctgccttcttttacttcttcttcttcttctttttttaaacagacagagtctcggcccggcatggtggctcatgcctctcagcctcccaaagtgctgggattataggcgtgagccaccgcgcctggccccgggcctttatttttatttttaaccttttgacaagacacgctttctattagagctgctttttgtctccctggttcgatttcctgatgtagaatcattgtgttgctgatttttcagttgaaaatgtttaaactgcttcctttgagaacaagtttgagttttagtaagctgtaaagctgttttatttgattcactg

SEQ ID NO: 34748 - DNA, 1930 bp, Homo sapiens
cttaaaaaaaaaaaaaccaaaaaaacccaaagcataactacttttgcagctgaacgtgactgtggcgtgcaggaagtggagcattggcatgaagtggctcctagtggctgcttggcgcacgccagctgccctcctctgactccagtggcacctgggggcctggcctcactgacgggagaacattggcgtgaaggctgctggcgactgggccagcattcattgtgaagaccggagggacacaccctgctgctcatgtctgcagggctctgagaggaggaagcctggggcaggacctgcgccagtggccgctgggcacagcatggagcaccccagcaagatggaattcttccagaagctgggctatgaccgggaggatgtgctccgggtgttgggcaagctgggcgagggcgccctggtcaacgacgtgctgcaggagcttatccgcacgggcagccgcccgggtgccctggagcacccggctgcacccaggctagtgcctcggggctcctgtggggtcccggactctgcccagcgtggcccggggacagccctggaagaggacttcagaaccctggccagttctctgcgacccatagtgattgatggcagcaacgtggcgatgagccatggaaataaagaaaccttctcttgccggggaatcaagctggctgttgactggttcagggacagaggacacacctacatcaaagtttttgttccatcctggaggaaggacccaccaagagctgacacccctatcagagagcagcacgtgctggcggagctggagcggcaggcggtgctggtgtacacgccgtcccgcaaggtgcacggcaagcgcctggtctgctacgacgaccgctacatcgtgaaggtggcctacgagcaggacggcgtcatcgtctccaacgacaactaccgggacctgcagagcgagaaccccgagtggaagtggttcatcgagcagaggctgctcatgttctccttcgtcaacgaccggttcatgccgcctgatgaccccctgggccgccatggaccctccctgagcaacttcctgagcaggaagccgaagcccccagagccatcctggcagcattgtccttatggcaagaaatgcacctatggcatcaagtgcaagttctaccacccggagaggccgcaccacgcgcaactggcggtggccgacgagctccgcgccaagacaggggcccggcctggcgcgggcgccgaggagcagcggccaccgagagccccgggcggctccgcaggagcccgggcggccccccgggaaccatttgcgcacagcctcccgccggcgcgggggtccccggacctggccgccctgcgagggagcttctctcggctggccttcagcgacgacctggggcccctggggccgcctctcccggtccccgcctgcagcctcacgccccgactgggcgggcccgactgggtgtccgcgggcggccgggtgccaggcccgctcagcctccctagcccggagagccagttctccccgggcgacctcccgcctccgcccggcctgcagctccagccgcggggcgaacaccgccctagggacctgcacggcgacttgctttccccgcgcaggccacccgacgacccgtgggcccgtccaccccgctccgaccgcttccctgggcgctccgtctgggcggagccggcctggggcgacggcgccactgggggactttcagtgtacgcgaccgaggacgacgagggggacgcgcgcgcccgggctcgcatcgcgctctacagcgtcttcccgcgtgaccaggtggaccgcgtgatggccgcgttcccggagctctcagacctcgccaggctcatcctcctggtacagagatgccagagcgcgggggcgcccctgggcaagccctaagggaccaacacgcacttgcagggaatg

SEQ ID NO: 34749 - DNA, 2753 bp, Homo sapiens
ggaagtggagcattggcatgaagtggctcctagtggctgcttggcgcacgccagctgccctcctctgactccagtggcacctgggggcctggcctcactgacgggagaacattggcgtgaaggctgctggcgactgggccagcattcattgtgaagaccggagggacacaccctgctgctcatgtctgcagggctctgagaggaggaagcctggggcaggacctgcgccagtggccgctgggcacagcatggagcaccccagcaagatggaattcttccagaagctgggctatgaccgggaggatgtgctccgggtgttgggcaagctgggcgagggcgccctggtcaacgacgtgctgcaggagcttatccgcacgggcagccgcccgggtgccctggagcacccggctgcacccaggctagtgcctcggggctcctgtggggtcccggactctgcccagcgtggcccggggacagccctggaagaggacttcagaaccctggccagttctctgcgacccatagtgattgatggcagcaacgtggcgatgagccatggaaataaagaaaccttctcttgccggggaatcaagctggctgttgactggttcagggacagaggacacacctacatcaaagtttttgttccatcctggaggaaggacccaccaagagctgacacccctatcagagagcagcacgtgctggcggagctggagcggcaggcggtgctggtgtacacgccgtcccgcaaggtgcacggcaagcgcctggtctgctacgacgaccgctacatcgtgaaggtggcctacgagcaggacggcgtcatcgtctccaacgacaactaccgggacctgcagagcgagaaccccgagtggaagtggttcatcgagcagaggctgctcatgttctccttcgtcaacgaccggttcatgccgcctgatgaccccctgggccgccatggaccctccctgagcaacttcctgagcaggaagccgaagcccccagagccatcctggcagcattgtccttatggcaagaaatgcacctatggcatcaagtgcaagttctaccacccggagaggccgcaccacgcgcaactggcggtggccgacgagctccgcgccaagacaggggcccgactgggtgtccgcgggcgacctcccgcctccgcccggcctgcagctccagccgcggggcgaacaccgccctagggacctgcacggcgacttgctttccccgcgcaggccacccgacgacccgtgggcccgtccaccccgctccgaccgcttccctgggcgctccgtctgggcggagccggcctggggcgacggcgccactgggggactttcagtgtacgcgaccgaggacgacgagggggacgcgcgcgcccgggctcgcatcgcgctctacagcgtcttcccgcgtgaccaggtggaccgcgtgatggccgcgttcccggagctctcagacctcgccaggctcatcctcctggtacagagatgccagagcgcgggggcgcccctgggcaagccctaagggaccaacacgcacttgcagggaatggcccagcctcgccttgcgtcttggacgggtggacctgtggttgccagcctggacctgagtgggcccatcatggtgcccccttttctttaaagatggtcagggaagcctgcttcctcctcctgagcggggttgtgggggcctggtggcacttggtgatcctcactgaggccggggcctgctgcggggaggtccacccacttccgtggagggaatgattttccatgtgcacggagactgcgggtccaagctgcagtagaacccacaagtgggtcacaaaatcaatttagtgggtcaccaccacaaacacagtggactgggacagggcaaagcgcaccctgtgccatcaggctgagtctgaactcttgttacctatcctgtgtccccacccccttggcagccatgtaactaacctcaatgtgggtcgtagtcagaagtttaaaaaagactatgaatgctcttgaatttcattgcttcaggtaatgtttgaaatatgtagtcaggtggccaggggaggtttgctatctggaagttttcatgttagctattgctaaccccacccgcaagggcagcccagcctccaggtgtgggctctcctgtgctctgaattgtgtggctgtcctatgctggggacaagtggtaggagcgctttgtcccagggccaccttctggggccttcacacacatacccccaccacacaaacacacacacacacacacacacacacacacagtctatcatacatgtacatactcacacacaccacacagacacatactgtttggctaagggttaagtatctccaatattttattagccatccatcatggcagtttccagaataggctttctactgtaccagctgagctgccttcttttacttcttcttcttcttctttttttaaacagacagagtctcggcccggcatggtggctcatgcctctcagcctcccaaagtgctgggattataggcgtgagccaccgcgcctggccccgggcctttatttttatttttaaccttttgacaagacacgctttctattagagctgctttttgtctccctggttcgatttcctgatgtagaatcattgtgttgctgatttttcagttgaaaatgtttaaactgcttcctttgagaacaagtttgagttttagtaagctgtaaagctgttttatttgattcactg

SEQ ID NO: 34750 - DNA, 1236 bp, Homo sapiens
ctgaacgtgactgtggcgtgcaggaagtggagcattggcatgaagtggctcctagtggctgcttggcgcacgccagctgccctcctctgactccagtggcacctgggggcctggcctcactgacgggagaacattggcgtgaaggctgctggcgactgggccagcattcattgtgaagaccggagggacacaccctgctgctcatgtctgcagggctctgagaggaggaagcctggggcaggacctgcgccagtggccgctgggcacagcatggagcaccccagcaagatggaattcttccagaagctgggctatgaccgggaggatgtgctccgggtgttgggcaagctgggcgagggcgccctggtcaacgacgtgctgcaggagcttatccgcacgggcagccgcccgggtgccctggagcacccggctgcacccaggctagtgcctcggggctcctgtggggtcccggactctgcccagcgtggcccggggacagccctggaagaggacttcagaaccctggccagttctctgcgacccatagtgattgatggcagcaacgtggcgatgagccatggaaataaagaaaccttctcttgccggggaatcaagctggctgttgactggttcagggacagaggacacacctacatcaaagtttttgttccatcctggaggaaggacccaccaagagctgacacccctatcagagagcagcacgtgctggcggagctggagcggcaggcggtgctggtgtacacgccgtcccgcaaggtgcacggcaagcgcctggtctgctacgacgaccgctacatcgtgaaggtggcctacgagcaggacggcgtcatcgtctccaacgacaactaccgggacctgcagagcgagaaccccgagtggaagtggttcatcgagcagaggctgctcatgttctccttcgtcaacgaccggttcatgccgcctgatgaccccctgggccgccatggaccctccctgagcaacttcctgagcaggaagccgaagcccccagagccatcctggcagcattgtccttatggcaagaaatgcacctatggcatcaagtgcaagttctaccacccggagaggccgcaccacgcgcaactggcggtggccgacgagctccgcgccaagacaggggcccggcctgttctccccgggcgacctcccgcctccgcccggcctgcagctccagccgcggggcgaacaccgccctag

SEQ ID NO: 34751 - DNA, 4194 bp, Homo sapiens
tgagcacaggtttcgcgggtagaaggcgtgcgcaggcgcggacacgggcgcatgcgcgttcactccggcgcgcagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatatattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 34752 - DNA, 2560 bp, Homo sapiens
actccggcgcgcagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaag

SEQ ID NO: 34753 - DNA, 1384 bp, Homo sapiens
gggtttactggaagaggagctatacagatggtacttagaggatgtagggccctacgtattagggcttcttagttgtagcgaagagcaattggtctggtacgtttagctttttcacatttagttttgaattctgactctagaaatgtacaaccccatcttttgaattacaggttttaagatgttatttgctcttaatacgtcttaaggtaacagccttgatcactgcttttactttcgatgaaataacttaatgagctgtgaagaaaaaattatcagattttaagggagagaattttatgaaaatgtctttgaggttcctgtcacctttatgagaatgtcttcaaagtttccatcaccacctctaccaatttttcttccaccggagccagtggacttaggttccataacaagctcctcttgttcactgaatgagctagacaatatttcccaccttttaaggaaaatatcagctgatatcaatgaaattaaaggaatgaaagcagctattttgacagtggaagcaaatctttttgatctaaatgttagagtgtccaagaatgaagcaaaaatttcatctttggaggttaaaatgaatgaatattcaacaacatatgaatgcaacagacagtttgaagatcaagaagaagatactgaatcacagtcaagaactactgatgtaaaaataatcggcttccttagaaacgttgagaaaggaactcaacagaggcaattattatcccgactgcaaatcgacccagtaatggcagaaactctgcagatgagtcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatc

SEQ ID NO: 34754 - DNA, 2007 bp, Homo sapiens
cggagcgtggctgcggctgaagtagccgccgggaaatggaaggacaggcgcaggcccggctggagccaccaccgcggcgcacggcgccgctttggatccgctgcgggagagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataata

SEQ ID NO: 34755 - DNA, 4004 bp, Homo sapiens
tgagcacaggtttcgcgggtagaaggcgtgcgcaggcgcggacacgggcgcatgcgcgttcactccggcgcgcagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatatagatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatatattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctg

SEQ ID NO: 34756 - DNA, 3800 bp, Homo sapiens
tgagcacaggtttcgcgggtagaaggcgtgcgcaggcgcggacacgggcgcatgcgcgttcactccggcgcgcagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatatattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctg

SEQ ID NO: 34757 - DNA, 1899 bp, Homo sapiens
gtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcct

SEQ ID NO: 34758 - DNA, 2195 bp, Homo sapiens
atggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaa

SEQ ID NO: 34759 - DNA, 4118 bp, Homo sapiens
tgagcacaggtttcgcgggtagaaggcgtgcgcaggcgcggacacgggcgcatgcgcgttcactccggcgcgcagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatatagatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatatattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctg

SEQ ID NO: 34760 - DNA, 1341 bp, Homo sapiens
agaggatgtagggccctacgtattagggcttcttagttgtagcgaagagcaattggtctggtacgtttagctttttcacatttagttttgaattctgactctagaaatgtacaaccccatcttttgaattacaggttttaagatgttatttgctcttaatacgtcttaaggtaacagccttgatcactgcttttactttcgatgaaataacttaatgagctgtgaagaaaaaattatcagattttaagggagagaattttatgaaaatgtctttgaggttcctgtcacctttatgagaatgtcttcaaagtttccatcaccacctctaccaatttttcttccaccggagccagtggacttaggttccataacaagctcctcttgttcactgaatgagctagacaatatttcccaccttttaaggaaaatatcagctgatatcaatgaaattaaaggaatgaaagcagctattttgacagtggaagcaaatctttttgatctaaatgttagagtgtccaagaatgaagcaaaaatttcatctttggaggttaaaatgaatgaatattcaacaacatatgaatgcaacagacagtttgaagatcaagaagaagatactgaatcacagtcaagaactactgatgtaaaaataatcggcttccttagaaacgttgagaaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgttttt

SEQ ID NO: 34761 - DNA, 652 bp, Homo sapiens
agtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgtatttgaaatacctgtggaatgaagagaaaaaaattaaagctaagccatcttgtccaatgtaattccagtagagctctgcgactctaaagcttagagctacatctatattttcaagcacatcaactttaagaagaaagttttgaggaaacaaagttttgatctacctttccttttaaatagatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatg

SEQ ID NO: 34762 - DNA, 580 bp, Homo sapiens
ttttcctagagccgcctttctcacatgcacgtttgctctttttctctcagagtgccattaaggggaaattacaagaattaggagcttatgttgtatttgaaatacctgtggaatgaagagaaaaaaattaaagctaagccatcttgtccaatgtaattccagtagagctctgcgactctaaagcttagagctacatctatattttcaagcacatcaactttaagaagaaagttttgaggaaacaaagttttgatctacctttccttttaaatagatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagatt

SEQ ID NO: 34763 - DNA, 813 bp, Homo sapiens
ggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgc

SEQ ID NO: 34764 - DNA, 2092 bp, Homo sapiens
cttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatcta

SEQ ID NO: 34765 - DNA, 593 bp, Homo sapiens
ctcctcccagcccccgcccgggggatccgaggtgcgcgcaccagcaaagtggcctcagccgctgcagagtccggtcttgttttcctagagccgcctttctcacatgcacgtttgctctttttctctcagagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcacc

SEQ ID NO: 34766 - DNA, 2529 bp, Homo sapiens
gaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagct

SEQ ID NO: 34767 - DNA, 7100 bp, Homo sapiens
gaaccgagagggggccaccccaggcggtcaccagcagatttgcccgcgcgttctctttctttccacccagttgcccttgcggccggctgtaaacctgccactaggacccggtcggtgagatctagcctcttgacctgagagccgagagtggatcgctgggctgggctaacggcgacggagagcgcgccctcgctgactccgggcgcgcccagcagtagcaccgcccgcgcccgcccctggacacttgtaagtttcgatttccgatttccgcggaaccgagtcccgcgccgcggcagagccagcacagccagcgcgccatggcggacccggaggtgtgctgcttcatcaccaaaatcctgtgcgcccacgggggccgcatggccctggacgcgctgctccaggagatcgcgctgtctgagccgcagctctgtgaggtgctgcaggtggccgggcccgaccgctttgtggtgttggagaccggcggcgaggccgggatcacccgatcggtggtggccaccactcgagcccgggtctgccgtcgcaagtactgccagagaccctgcgataacctgcatctctgcaaactcaacttgctgggccggtgcaactattcgcagtccgagcggaatttatgcaaatattctcatgaggttctctcagaagagaacttcaaagtcctgaaaaatcacgaactctctggactgaacaaagaggaattagcagtgctcctcctccaaagtgatcctttttttatgcccgagatatgcaaaagttataagggagagggtcggcagcagatttgtaaccagcagccaccgtgttcaagactccacatctgtgaccacttcacccgagggaactgtcgttttcccaactgcctccggtcccataacctgatggacagaaaggtgctggccatcatgagggagcacgggctgaaccccgacgtggtccagaacatccaggacatctgcaacagcaagcacatgcagaagaatcccccagggcccagagctccttcttcacatcgtagaaacatggcatatagggctagaagcaagagtagagatcggttctttcagggcagccaagaatttcttgcgtctgcttcagcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacgattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccacctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagaccatcagccagcaaagacctcgtcagtgtctttaactgcgacctttcgtcctcaggaggacttttgcttcctatcctcaaagaaatataagttgtcagagatccatcacctacatccagaatatgtcagagtaagtgagcattttaaagcttccatgaaaaatttcaagattgaaaagataaagaagatcgagaactcagagctcctggataaatttacatggaagaaatcgcagatgaaggaagaaggaaaactcctattttatgcgacaagccgtgcctatgtggaatctatctgttcgaataattttgacagtttcctacatgaaactcatgaaaacaaatacggaaaaggaatttactttgcaaaagatgccatctattcccacaaaaattgcccgtatgatgccaaaaacgtcgttatgtttgtagcccaagttctggttggaaagtttactgaaggaaatataacgtacacgagccctcctccacagttcgacagctgtgtggataccagatcgaatccctccgtttttgtcatctttcagaaagatcaggtttacccacaatatgtgattgaatatactgaagacaaagcctgcgtgattagttagaaccgatgaatacagcgtcagaaggatgccataaccattctgttcctttacagaactaaattgccgcagacaggagttaaagttttatattttcctgctcagttatctaatgtcttagatcagtggtccccaaattttgctacatattagaatcatctgggaggttttaaacaaattctgatgcccaggttgcaccccatgccaatgaaatcatttctgggcgtcagcgccaggcagttgtatttttttttttttttttttttttgagactgaatctcactccatcgtccaggctggagtgcagtggcgcgatctcggctcactgcaacctctgcctcccgggttcaagcaattctcctgcctcagcctcccgagtagctggaactacaggcacacactgccgcgcccagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgatgattccaatgtgttggaaagtttaccttgtctcagatgtaactggtaaaggctgatttctaaattttctgtaattgcagcaacctttctctcctgtctacccttttagtttactgtatgccatggttttgttttggttacattgaaagaaagttaatttggaaaatttgggagaaatctaatcatgcctattaaggatgtaagacattacagccttagaagaaagattgtgaaaagctggggagaaaatgcttaaggacatgctaggggaaaaaaaagtaaaattgaagtgctattgcagacatggctgcagtactgtaccttatcattctgatgaaactgatttggagcacccttttctttatcgctacatttatttaggggacaaactccatccaggttgactctctctggaatgcggtaataagagctggcaagtaaggctcagagagaagcaaccaactggagttaattgcccatttgggctctttgtataattatggcaaagtagacatttatgttctaattaatatgattacagagaaggctttttctcaggtcaggcttttcatgaaagtattttgagaacaatgaattgcaataaccagcttcacacaagcataactgataaacgcgagtgctattgtagtcttggcaagtgagccaagaacctaggagcagggccattcctactgaaggacgggccccctacggagatgaaatttgtttcctggtgagcacagaatcagaacaaagaacaatatcccaaagaggccctgtgtctaccaggagcttctttttccaaatgtaatggattatgtggaattgtagtgccatcggtttttacttagagcccttgacgtgcttggaccaatatttccttccttcttatgaaccaggtttttccttctgattttcccttttcaacattccttaccagtcaccaaagtttcctgttataatttcttttagcagacaagttataagtcagatttaattagcatcagagttgattttatattagtcagattttggatcatcacagagatctccacaactccttggcttaaacagctccaccggtaaaaaaaaaaaaaaaaaaaaaaaaaaaaaatagtttttttagagtagagttattttctgggagagttactacaaatgcttattctcattgacttatttctttcatggtaactttcgttttggagtgttcattttctgaacttgaccctcacattgtaggggtgcagtttgtccaactctttccaacagcccattagacaccactagctggatatttcacaggcatctttgattcaatatgtccaaagtggaactctccatctacctccctcacatgaacctgttcctctctcaggatctgtatgtaagtgaaaagcatcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaa

SEQ ID NO: 34768 - DNA, 3182 bp, Homo sapiens
cttttagtttctcttctttctaaagaaggctcgcggagcccggctggagaacctcaccctcgccgagcctagaaccgagagggggccaccccaggcggtcaccagcagatttgcccgcgcgttctctttctttccacccagttgcccttgcggccggctgtaaacctgccactaggacccggtcggtgagatctagcctcttgacctgagagccgagagtggatcgctgggctgggctaacggcgacggagagcgcgccctcgctgactccgggcgcgcccagcagtagcaccgcccgcgcccgcccctggacacttgtaagtttcgatttccgatttccgcggaaccgagtcccgcgccgcggcagagccagcacagccagcgcgccatggcggacccggaggtgtgctgcttcatcaccaaaatcctgtgcgcccacgggggccgcatggccctggacgcgctgctccaggagatcgcgctgtctgagccgcagctctgtgaggtgctgcaggtggccgggcccgaccgctttgtggtgttggagaccggcggcgaggccgggatcacccgatcggtggtggccaccactcgagcccgggtctgccgtcgcaagtactgccagagaccctgcgataacctgcatctctgcaaactcaacttgctgggccggtgcaactattcgcagtccgagcggaatttatgcaaatattctcatgaggttctctcagaagagaacttcaaagtcctgaaaaatcacgaactctctggactgaacaaagaggaattagcagtgctcctcctccaaagtgatcctttttttatgcccgagatatgcaaaagttataagggagagggtcggcagcagatttgtaaccagcagccaccgtgttcaagactccacatctgtgaccacttcacccgagggaactgtcgttttcccaactgcctccggtcccataacctgatggacagaaaggtgctggccatcatgagggagcacgggctgaaccccgacgtggtccagaacatccaggacatctgcaacagcaagcacatgcagaagaatcccccagggcccagagctccttcttcacatcgtagaaacatggcatatagggctagaagcaagagtagagatcggttctttcagggcagccaagaatttcttgcgtctgcttcagcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacgattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccacctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagagtaagtgttctgaagcagctgtttgctgacagatgcttgagatgttcatgccctgggctcatcaagtcactcgtgaatctggagcctgttttcctgaaaagttcctgtttgcattactctgcagtttccatttgcattatcgatgagtaagatgcttgttaagcagcatggtgtgactgaaaggatactagatcggaaaatgaattttctttctgaaagggaagtctgagcgagtctcctaaatactctgggctttagcttctccagctgtgaagagctggattgatgcagtacacctaaggaataatcatatatactgggtttttgttttgctgtggattcttttttttttttttttttttagagggggtctcactttgttgcccaggctggtcttgaactcctgagctcaagtgatcctcctacctcagtctcccaaagtgctgggattacaggcatgagccaccgtgcctggctttgctgtggattcttttgggtgtcttttgttttcctacacgatttatagaggatgaggggcggagaaagagatagaaaaaagggatgagctagctgttagagcaagggttttggtgagagataatattgattgaagggattttaaaggaaatgttgctgtgggggattcattgtaactctccttgtgaactgctcagtaaactctacattgttcatgaaca

SEQ ID NO: 34769 - DNA, 2264 bp, Homo sapiens
agagccagcacagccagcgcgccatggcggacccggaggtgtgctgcttcatcaccaaaatcctgtgcgcccacgggggccgcatggccctggacgcgctgctccaggagatcgcgctgtctgagccgcagctctgtgaggtgctgcaggtggccgggcccgaccgctttgtggtgttggagaccggcggcgaggccgggatcacccgatcggtggtggccaccactcgagcccgggtctgccgtcgcaagtactgccagagaccctgcgataacctgcatctctgcaaactcaacttgctgggccggtgcaactattcgcagtccgagcggaatttatgcaaatattctcatgaggttctctcagaagagaacttcaaagtcctgaaaaatcacgaactctctggactgaacaaagaggaattagcagtgctcctcctccaaagtgatcctttttttatgcccgagatatgcaaaagttataagggagagggtcggcagcagatttgtaaccagcagccaccgtgttcaagactccacatctgtgaccacttcacccgagggaactgtcgttttcccaactgcctccggtcccataacctgatggacagaaaggtgctggccatcatgagggagcacgggctgaaccccgacgtggtccagaacatccaggacatctgcaacagcaagcacatgcagaagaatcccccagggcccagagctccttcttcacatcgtagaaacatggcatatagggctagaagcaagagtagagatcggttctttcagggcagccaagaatttcttgcgtctgcttcagcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacgattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccacctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcaggaagagagggccagagtaagtgttctgaagcagctgtttgctgacagatgcttgagatgttcatgccctgggctcatcaagtcactcgtgaatctggagcctgttttcctgaaaagttcctgtttgcattactctgcagtttccatttgcattatcgatgagtaa

SEQ ID NO: 34770 - DNA, 1827 bp, Homo sapiens
gcccggatctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagaaatgagtggtggattggctccaagtaagagcacagtgtatgtatccaacttgcctttttccctgacaaacaatgacttgtaccggatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtggggaaagtggacacttaagttatgcctgtccgaaaaatatgctcggagaacgtgagcctccaaagaagaaagaaaaaaagaaaaaaaagaaagctcctgaaccagaagaagaaattgaggaagtagaagaaagtgaagatgaaggggaggatcctgctcttgacagcctcagtcaggccatagcattccagcaagccaaaattgaagaagaacaaaaaaaatggaaacccagttcaggagtcccctcaacatcagatgattcaagacgcccaaggataaagaaaagcacatatttcagtgatgaggaagaacttagtgattaaaatcttgccccagcacagtaataaaaatcaagatttgttagtaacaatcttgaagagctaattttaataaaaataagaaaaattaatactatcatgttaatactattattgtcatcccaagaaaaaagatattttaaaaatttatttgaaaagttcattataagggctttattcatgcctgatttgtttacatgaggacttctgaaattaatccttaaaacaaacttcctgaagaccgaaaagttgaatgatttattgttacttatattaataaacttttcaagagaattttgtctttaaatatgggtgttttgtcatcatatttcttgtagctttatcccaatctggataaattgtaaatacctataaaataaattataaatacctataaaatataaagtaacatagctctaaaaggcttaaaatcaaacacaggtgttatttgtctgccctacccatagcaccaaattccattccctagaagaaactacttacatgtgcacacatgtagctaaataaagtacatatatttcagtcacttaataaaagaataaaggagaattattcaatctcttatacttctcctaccttcctcaatattcccaatgtggctgtattaaaaatttgggggaatccatatatatcttttttaataaccaagtaaatacttttcatttctgagccaaggaatatgctatgattacgttttttcctagagttaataattgtctattttttttccatgtattgtctttgtatttatgactaaatcttcccattctgtctgcaggtgggtatatggtaatgggattagagagcctttaattttctgctttgtatatttctatattgtttaactttgtaagaatgcccattacttttttaactagtaaaagcaatagaaataagttaatactatcatagtaatattattattgtcatcccaagaaaaaatatattaaaaagatatttgaaatttcattataaaa

SEQ ID NO: 34771 - DNA, 1354 bp, Homo sapiens
agttcacactggctgttgtcagcggcctctgaggtttcaggctcttggcggtgaaggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcagaagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgtgaatagtgtgatgaaattttgcactgtcctgctctttcctgctcaggatgcaaatcagtgaatctttttttttttttt

SEQ ID NO: 34772 - DNA, 2774 bp, Homo sapiens
ctattcccaggagggtaaaaaagcgggaacaatggctttcaggacggagggacacaaacacccaatgccgcagcgactgggagggtcgcgatgcaggaggacgaaatgggagaagggggacaagggggacttcggcctccctgcgggcgggagctaggccgctggaaagtccgctcgcctctcgccggcaagggatgacgccctgggccttttgtaccactcgccacggaaaatggtcacacgcttttgtcctcaagccgaacactatcagaaacacggggtccctggaagccgccatcttggccattggcggtggcgcacccacccccgtgctactgcgcgtgcgcggcgctgcgacacactccgaccccatcccgcgttcccagggggcggtgggaagcggaagtgctccgctgacccgggagggcggtccctagttcacactggctgttgtcagcggcctctgaggtttcaggctcttggcggtgaaggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggacaggccagaagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgtgaatagtgtgatgaaattttgcactgtcctgctctttcctgctcaggatgcaaatcagtgaatctttttttttttttttttgagacagagtcttgctctgtcatccaaactggagtgcagtggcacaatcttggctcactgcaacctccgcctcttgggttcaaccgattctcctgcctcaacctcccaaatagttgggattacaggcacatgccaccatacgcagctaatttgtatttttagtagagacagggtttcaccatgttggccagcctggtcttgaactcctgacctcaagtgatccgcctgcctcagcttcccaaagtgctgggattacaggcatgagccactgcacccggcttgaatcatccttttgtccagtattatatccatgctgtatatgctacccgcccactagtcccttagctgtctcagttgtcagattgactgtcatgggattgcagtgcttgcattaaagctacccttattgtataatgaccccaaagtgcaagagtagtgatgttggcaatttgcatacaccaaaaataagttataaagtgcttccttaaagtgaaatggttaaagttcttgacttaataaagaaaaaaaatgtatgctgaggttgttaagatttacagtaagaatgaatcttctatccaagaaattgtgaaggaggaaaaagaaacttgtgctagttttgctgtcacatctgaaactgcaaaagttgtggccacagtgcatcataagtgctaagacgaaaaagacattaaatttgcggatggaaggcgtgaatagaaatgggttctgacagcaatcaggttcggtactattcacagtttcaggcatccgctagggatcttggaacatatcccccatggataagggaggggtactgtaccttgtcatattgtgcattaaagaattcattgagtgtaatcatgtaagtctaacacacatttaaaaagctctcagatatcatttcgccttcggttgatgtaagaaaattcaaaagctactcaaatcattcaataaatgataaaattattta

SEQ ID NO: 34773 - DNA, 2485 bp, Homo sapiens
ctactgcgcgtgcgcggcgctgcgacacactccgaccccatcccgcgttcccagggggcggtgggaagcggaagtgctccgctgacccgggagggcggtccctagttcacactggctgttgtcagcggcctctgaggtttcaggctcttggcggtgaaggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggacaggccagatgtatccatttttgcctcatgtattttgaagtgctgttattagaagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgtgaatagtgtgatgaaattttgcactgtcctgctctttcctgctcaggatgcaaatcagtgaatctttttttttttttttttgagacagagtcttgctctgtcatccaaactggagtgcagtggcacaatcttggctcactgcaacctccgcctcttgggttcaaccgattctcctgcctcaacctcccaaatagttgggattacaggcacatgccaccatacgcagctaatttgtatttttagtagagacagggtttcaccatgttggccagcctggtcttgaactcctgacctcaagtgatccgcctgcctcagcttcccaaagtgctgggattacaggcatgagccactgcacccggcttgaatcatccttttgtccagtattatatccatgctgtatatgctacccgcccactagtcccttagctgtctcagttgtcagattgactgtcatgggattgcagtgcttgcattaaagctacccttattgtataatgaccccaaagtgcaagagtagtgatgttggcaatttgcatacaccaaaaataagttataaagtgcttccttaaagtgaaatggttaaagttcttgacttaataaagaaaaaaaatgtatgctgaggttgttaagatttacagtaagaatgaatcttctatccaagaaattgtgaaggaggaaaaagaaacttgtgctagttttgctgtcacatctgaaactgcaaaagttgtggccacagtgcatcataagtgctaagacgaaaaagacattaaatttgcggatggaaggcgtgaatagaaatgggttctgacagcaatcaggttcggtactattcacagtttcaggcatccgctagggatcttggaacatatcccccatggataagggaggggtactgtaccttgtcatattgtgcattaaagaattcattgagtgtaatcatgtaagtctaacacacatttaaaaagctctcagatatcatttcgccttcggttgatgtaagaaaattcaaaagctactcaaatcattcaataaatgataaaattattt

SEQ ID NO: 34774 - DNA, 993 bp, Homo sapiens
ttcacactggctgttgtcagcggcctctgaggtttcaggctcttggcggtgaaggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggacaggccagatgtatccatttttgcctcatgtattttgaagtgctgttattagtgagagttattttccatggaaattctgtgtaccctaagctatgaaagcatcactgcagaactatttggattgccactgctggggcccactggtttcactaatgcaggaacaatttataggtgaatttatcaacttcgggggttttgtattatacttcaaatgtccatttggaatgcactcctacatgtggtacaggactgtggttctgacttcttgtaagtaacccctgattcttcttaacattttcattagccagtgggtgacatctttctagttcctattttacacacagagatgtcctttgtgactcccagctttaagcaggtagctcaattctaattctctgcacatttgtgccctgtggcctagaattcacctcacactcatgattagagccttagtcccccaactgcaaagccacacagcttcaatttctgttcactccctcactttaaatttcttcttcatttttgtcacataataaatttattttctggtttga

SEQ ID NO: 34775 - DNA, 2142 bp, Homo sapiens
gttgcaatgagccaagaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggacaggccagaagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgtgaatagtgtgatgaaattttgcactgtcctgctctttcctgctcaggatgcaaatcagtgaatctttttttttttttttttgagacagagtcttgctctgtcatccaaactggagtgcagtggcacaatcttggctcactgcaacctccgcctcttgggttcaaccgattctcctgcctcaacctcccaaatagttgggattacaggcacatgccaccatacgcagctaatttgtatttttagtagagacagggtttcaccatgttggccagcctggtcttgaactcctgacctcaagtgatccgcctgcctcagcttcccaaagtgctgggattacaggcatgagccactgcacccggcttgaatcatccttttgtccagtattatatccatgctgtatatgctacccgcccactagtcccttagctgtctcagttgtcagattgactgtcatgggattgcagtgcttgcattaaagctacccttattgtataatgaccccaaagtgcaagagtagtgatgttggcaatttgcatacaccaaaaataagttataaagtgcttccttaaagtgaaatggttaaagttcttgacttaataaagaaaaaaaatgtatgctgaggttgttaagatttacagtaagaatgaatcttctatccaagaaattgtgaaggaggaaaaagaaacttgtgctagttttgctgtcacatctgaaactgcaaaagttgtggccacagtgcatcataagtgctaagacgaaaaagacattaaatttgcggatggaaggcgtgaatagaaatgggttctgacagcaatcaggttcggtactattcacagtttcaggcatccgctagggatcttggaacatatcccccatggataagggaggggtactgtaccttgtcatattgtgcattaaagaattcattgagtgtaatcatgtaagtctaacacacatttaaaaagctctcagatatcatttcgccttcggttgatgtaagaaaattcaaaagctactcaaatcattcaataaatgataaaattattt

SEQ ID NO: 34776 - DNA, 1247 bp, Homo sapiens
gacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggacaggccagatgtatccatttttgcctcatgtattttgaagtgctgttattagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgtgaa

SEQ ID NO: 34777 - DNA, 1874 bp, Homo sapiens
ggagccgcgcgcccccgtgcccgcgtctgtccgtgcgcccgagcgcccactcccgggtctgaggtctgcccggcgcgccgcttgcagagcatactcagggccgcgcacctgccccgcgcacctgcccgccgcccgctcggcgctccgggcttcgctagccagcctccctgcgacagcgcgggggctccggccgtgcctccgcgtccgccccgcgcctcagccgggcccgggcgcagcgctgcggagggcgagggccgcccggagtccggccagggccggcgcggcgatgatgaacaggttccgaaagtggctctacaaacccaagaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcagagtttgagctcagctacgtctcggccatggtgcctgtgaagtcccccagggagtactacgtgcagcaggaggtcatcgtgctcttctgcgagacggtggagagggccctggacttcgggtacctgactcaggacatgattgatgactacgagccggccctcatgttcagcatccccaggctggccatcgtgtgccccctccttccagcccatcccagaacacgtgcaggagccaccgcccacgtggcctgcaggatggttgccggatcctcttcaggggccctcacccatccacctgtgtcaaaacaaggtgtcatctctgccctgctcagacccttgccggagctcccaccgtgatctgcctgcaccgtgcccacaccagtcctctctccccagtccccacgcacccgctgccctgggtctccaccatgctgtccccttcgctcagggtccccttgactgtcctatccctactgccacactgtcccctcccccgcactgtccccttttccatgatgtttcctcctccacgctgtcccctctgctccagtgtcctcttggccatgctgtcctctccatggtgctggcccctccactacactgtcccctcctctatgctgtccccttgtctatgctgttccctcctctatgctatcccattctccatgctatcccattctccatgctgtcccctcctccatgctgtcccttcctctgcaatgtcctctcccctgtgctcctctgcactgtcccctcctccatgctgtcccctcctttatgatgttccctcctccgtgctgtcccctccatgatgtcccctcttccgtgctgtcctctcctctgcactgtcccctactccctgctgtacctccctctgcgatgtccccaccactgcaccgctcacccaagccctctcccaccagcaggttgcgtgacttactctgttatttatttttccatgttactgagataaaattcattaccctatgactcacccatctacagtgcacagtcgtttttggtacattcagaattgtgcagccatcaccacaaatttcataacattttcattactcacaaa

SEQ ID NO: 34778 - DNA, 1135 bp, Homo sapiens
gcggccgtgaccagcggagcgctgggtgtcagtgagcagcgaggagccgcgcgcccccgtgcccgcgtctgtccgtgcgcccgagcgcccactcccgggtctgaggtctgcccggcgcgccgcttgcagagcatactcagggccgcgcacctgccccgcgcacctgcccgccgcccgctcggcgctccgggcttcgctagccagcctccctgcgacagcgcgggggctccggccgtgcctccgcgtccgccccgcgcctcagccgggcccgggcgcagcgctgcggagggcgagggccgcccggagtccggccagggccggcgcggcgatgatgaacaggttccgaaagtggctctacaaacccaaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcagagtttgagctcagctacgtctcggccatggtgcctgtgaagtcccccagggagtactacgtgcagcaggaggtcatcgtgctcttctgcgagacggtggagagaaatggaaaaggtgttctaaaattcatgtggaactgcaatgggccctaaatagccaaaacaatattgaaaaacaaaaacaaaattggaagattcatacgtcctgatttcaaaacttactacaagtcaaaaccttatggtactggcataaagatagatgtatagaccaatggaataaaattgagaagccataaataaacccaaacatctatggtgaactgattattgacaagggggccaagatcattcaataaggaaagaacagtctcttcagtgaatgttcctggagcaactggataaccacatgcaaaagaacaaagttggaaaaaaaaaaaaaaa

SEQ ID NO: 34779 - DNA, 1590 bp, Homo sapiens
gtcacccgctcggaggccgtgggcgccttgacgagggcgcggcggcgggaatgcacaacgttatgctcatcacctgcgtccaccactgtcacccctgacggcgagacgcgaggtgctaagggcttgtccaggctaagcgggttctctgcgtccttaagcccactttgcagatgctaatcagaggggacaggcggccaagaacctggagcccacccgggcgtctgtgcccagtgccgaccgtctaaattcccttcccacgtggctcctgttgcgtctgggctgtggaggattcctctaaacaggcacagccaccctctggaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcagagtttgagctcagctacgtctcggccatggtgcctgtgaagtcccccagggagtactacgtgcagcaggaggtcatcgtgctcttctgcgagacggtggagagggccctggacttcgggtacctgactcaggacatgattgatgactacgagccggccctcatgttcagcatccccaggctggccatcgtgtgaaatggaaaaggtgttctaaaattcatgtggaactgcaatgggccctaaatagccaaaacaatattgaaaaacaaaaacaaaattggaagattcatacgtcctgatttcaaaacttactacaagtcaaaaccttatggtactggcataaagatagatgtatagaccaatggaataaaattgagaagccataaataaacccaaacatctatggtgaactgattattgacaagggggccaagatcattcaataaggaaagaacagtctcttcagtgaatgttcctggagcaactggataaccacatgcaaaagaacaaagttggaaaaaaaaaaaaaaaagaacaaagttggaccctgcgatggttaacttcatgtgtcatcttgggtaggccacattacccagatatttggtaaaataccagtctgaatgttgctgtgaaggtatttttttttctttttataatgataaactggcaatttataattgcgcagatttatagcatgcaaagttgtgttataatctatgaatgcagtgtggaataattaaatcaagctggttaacatatccatcacctcaaatatttaacatcttttgaatgagatcatttta

SEQ ID NO: 34780 - DNA, 16064 bp, Homo sapiens
ccgcgcgtccctgtgcgtccccgggtccctgcgggcgggcgggcgcggtcgccgccgagcaacccggcctgcgcccggcacgactgtagatgtcaggctttgcccggggagccgagcggcagcggggctgtgagtttcaaattaaccttccgctttgttgctgtgtaatgtggatccccgaaggccccccgccccgcccgccccccttccccgggcggtgcgcgctgcaaactgcgagttgggcttcatttacataaagcgattccgggcgggcggcggcagaggaggaggcggcggcggcgggcaggccggggacccggacgccagcgccgcgccccgtgggtgaatccccgccgcgtcccggggacctccctccggggacgggccgaccgccagccctgccgccaccatgagctcccctcccctgtctccgggccccctgctcctgaccagagccacctccgagtcctggggccagcgggaggtggggagcatgccgcctggggtgggtgagctcggggctcgggtgccactggaatttcccgttgttgcgcatggcggcgcggcccccggacctgcaagtgccgcctccctccggaggtgcgcggaggcttggtgtgccaggtccgagcctccgtactgggtgcaatgaaagctccacgcaggccttaccatggaaggctgtgactcgcccgtcgtctcggggaaggacaatgggtgcggtatccctcagcaccagcaatggactgaactcaacagcacccacctccctgacaaacccagtagcatggagcagtccacaggcgagagccacgggcccttggacagcctgagggcccccttcaatgagcgcctcgcggagagcaccgcgtcggccgggcccccctccgagcccgccagcaaggaggtcacctgcaacgaatgttcggcctcctttgccagcctccagacctacatggagcaccactgccccagcgcgcgccccccgccacccctgagagaggagagcgccagcgacaccggtgaggagggggacgaggagagtgacgtggagaacctggccggggagatcgtctaccagccggacggctccgcgtacattgtggagagcctgagccagctgacccagggcgggggcgcctgtgggagtggcagtggcagtgggcctctcccctcgcttttcctgaactctctccctggcgcggggggcaagcaaggggacccttcgtgtgctgcacccgtgtacccgcagatcatcaacactttccacatagcctcatccttcgggaaatggtttgagggcccagaccaggctttcccgaatacctcagccctggcggggctcagccccgtcctgcacagcttccgcgtgtttgacgtgcgacacaaaagcaacaaggattacctgaacagcgacggttctgccaaaagctcctgcgtatccaaagatgttcccaacaatgtggacctgtccaaattcgatggctttgtgctctatggcaagaggaagcccatcctgatgtgtttcttgtgcaaactctcctttgggtacgtccgttcgtttgtgacccacgcggtgcatgaccatcgaatgaccctgagcgaagacgagcggaaaattcttagcaataagaacatctccgctatcatccaagggatcggcaaagacaaggaaccccttgtaagttttctggaaccaaaaaacaaaaactttcaacaccctttagtttccacagctaacctcataggccccggacacagtttttatggtaaatttagtggcattcgaatggaaggggaggaagctctcccagcgggctccgccgctggccccgagcagccccaggctggtctcttgacccccagcaccctgttgaaccttggcgggctcaccagctcggtactgaagacccccattacctcagtccccctggggcctctggcttccagtcctaccaaatcctcagagggcaaggactctggggcggcagaaggagagaagcaggaagtgggcgacggggattgcttctctgagaaggtagagccagccgaagaggaggcggaggaggaagaggaggaggaagaggcggaggaggaggaggaagaagaggaggaggaagaagaggaggaggaagacgagggttgcaaaggactctttccaagcgagttggatgaggaactggaggacaggccccatgaggagcctggggccgcagcaggtagtagcagcaaaaaggaccttgctctctcaaaccaaagcatttctaactcccccttaatgcctaacgtgctccagaccctgtcgaggggcacagcttctactagttctaattctgcttcttcctttgttgtctttgatggtgcgaacaggaggaatcgtttaagctttaacagtgagggcgtcagggccaatgtggcagagggcggcaggaggctggacttcgctgacgaaagtgccaataaagacaatgccacagcaccagaaccaaatgaaagcacagagggtgacgatgggggcttcgttccccatcaccagcacgctggctccctctgcgagcttggggttggggagtgcccctcggggagtggcgtggagtgccccaaatgcgacacggtcctgggctcctcccgctcgctgggcggccacatgaccatgatgcattctcgtaactcgtgtaagacactcaagtgccccaagtgcaactggcactataagtaccagcagaccctggaggcacacatgaaggagaagcacccggagccggggggctcctgtgtctactgcaaaagcgggcagccccacccccggctggcacgaggcgagagctacacgtgtggttacaagcctttccgctgcgaggtgtgtaactactccacaactaccaaaggcaacctcagtattcatatgcagtctgacaagcatctcaacaacatgcagaacctgcagaatggagggggggagcaggtcttcagccacactgccggggcggcggcggcggcggtggctgcggcggcggcggcagccaatatcagtagctcctgcggggccccctcgccgaccaaaccaaaaaccaaacccacctggcggtgcgaggtgtgtgattatgagaccaacgtggccaggaacctccgcattcacatgaccagtgagaagcacatgcataacatgatgttactgcaacagaacatgacccagatccaacacaaccgccacctgggcctcggcagcctgccctcacccgccgaggccgagctctaccaatactacctggcccagaacatgaacctgcccaacctgaagatggacagtgctgcctcggacgcccagttcatgatgagcggattccagctggatcccgccgggcccatggccgccatgacgcctgctctagtgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtgaccacccctgagatggtgatgccaagcagcatgttcctcccagcagctgttccagatcgagatgggaattccaatttggaagaggcaggaaagcagcctgaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggcagaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgacaactgagaccctgctgcaactacagcagcagcagcacctcctcttccctttctacatccccagtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggagatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcggcaactacagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaaaaaaaaaaaaaaaaagaaaaaaaagaaaaagcgtgggttgttttcccatatacctatctatgccggtgattttacattcttgtctttttcttttcttttaatattaaaaaaaaaaaaaaagccctaaccctgttacattgtgtccttttgaaggtactattggtctgggaaacagaagtccgcagggcctccctaatgtctttggagcttaaaccccttgtatatttgccccttttcaataaacgccccacgctgatagcacagaggagcccggcatgcactgtatgggaaagcagtccaccttgttacagttttaaatttcttgctatcttagcattcagataccaatggcttgctaaaagaaaaaaagaaatgtaatgtctttttattctcaggtcaatcgctcacactttgttttcagaatcattgttttatatattattgttttttcagtttttttttttttttttgttccagaaaagattttttgttttgttaacttaaaaatgggcagaaagtattcaagaaaaacaatgtgaactgctttagctttctggggatttttaaggatagcttttctgctgaagccaatttcaaggggaaaagttaagcactcccactttcaaaaaaaaaaaaaaataataacccacacacacaaagagtgttgaggacttgtagcttaaaaaaaataagttttaaaaactgactttctgtatttatgatagatatgaccatttttggtgttgagtagattgttgcattggaaatgaactgaagcagtatggtagatttaaaaggaaaaaaaaaaaaaaaccttttgtgtacatttagctttttgtatggtccagctgacagctcctcatttgatgttgtcttgttcattcctagcagatgatagattgcaatccgttgattcgcctaagcttttctccccttgtcccttaattccactttctctttcttgtcccttaattccactttctctttccttctcccacctcccgtcctataatctcccacttaaggtagctgccttcatttcttagagggagctgcagaattattttataaaactaaagaaagaatttcaagggattctaggggtcattaggatcctcacagattatttttggttggggagttgaaactttttaaaggcatataattctagttacctgtgtctgttagctttgtgcatttattttttatttatccttcttttggcttttttttctttgtaccccttcttttcctccttgtttggtaggagcttcaaatattctttttttttctatactaaaggatttgtttccatttgtgtaattggctgtgtacttttcttttctaaaaaaagtttttggttagggatttggtttttggttttgtgtttgttttttctttcctctctcagaaaaaaaaatttcatgctttaaataaaatccaaagacacaccctttcactgctgatgcagaaaaaagggaaagggttcttgttacttgagaatttgtttctgatttaaacaaacaagacttagtttaataaaagaaagagaaaaacaaaagattcccaggttgttatgtgcttcttctgcaagcagagaggcaaatgttaatgacaattccatataccaaaagacacattttttacttcaaagttttgtccttgtgttaggcagtctgagcagcgagtgatccagagcgcagccaacaaagcagcagatagcagtgtacagaaagcaaaaaaggaactgtatgtgaggcacttgtttctgttaatatccatattcctgttaacacacaccctttctcatgtaaaaagaaaaataaataaatggtctgaactttgaaaactttgtgctgctaaaacatagattttggagacaaataaatagatgctttgctgtttcactttcatagctaaacatcaacagaaaccatctccccttgcccccaaagtgtgaaatccttcttcccttcgttttcttccttatgtttcaaaagggaactttgaagactgtgaatacaggttccattggtcacctttcgggcttctttccccagtgctgaagccactcatcgactttgcaaaagactggagcattccaagatctgaaaatggattttttttctttttttcttttttagccgggactattttatttttatgaatttgtttttagtttaatgaaatagtagatcctgaaatgttgtacatatttctaactaggctgatgcacagtgcaaattccttttttaattgttttttttaagtagaaatactaaagaaagaataccatctaactattcataccagtatccagttgtagcataaggtgtcaaaagcaagtacgcaaaacatttactgttttaacaagctatttccttttaacaagaaatcttgtatttcttcctgtgtttgagatgaacatttttaaattttaaagttgtacagttttttgttttccattattttatcttgtttgtaactctatgaaatatatatatatatattttttgccatttaactgttgtatgttactctgtgtctgtaccatatagaaaaaaaattgtttttgtttttggttctctatgtgatatcagttaacaatgtaacactagctttacctgtcaaattctgctaggtcttctctgaaaacgttgtttttaaaaatgatattgcttggtaatagtgcaatttctatccttttccctcccccctcaacttttaagttcttttctttataattttgctgccccctccctgatggtttgggtttttgtttttgtttttgtttttttttttcatggagctactatgccatcctccctctgtgaggcagagtgactgtcagtgttttgttatgccatgccttgagctgtgggtgtttggcgacaataaggtggttgaatagattggctgagcacacttccacccacctagtgttctcagaggggttatgtgattgtttcaacctggagtgggttgcacccttaatgctttcctctgcaactaaaccgcccacatatatgttcattgaaaaaagtaagaataattctcagcactaacccagaagtagcaaagcagtcagtgatggtgaacattagaggtcaaacatgagttagatgtttgtgggctgacagccatcgtggctatgaccagtactatttacaaagcatgaattcactacaatgctcaactgtttgtttagctttatctcacttggggaatttattcctgtctgctgcattgtaggtagctgggtaggatatatttccacttgctttttaaattagttcttcacctccattgacactcgttttttggttttctccctatagtgtgggttggtgctagacaccagtctgacccacagaatgggagttatttcatccatctttcctccatccttccaaaaaccacatatctacacaaggaaaaatttaatacatctaggaattttttttttaattacaagctatttaaagagatgaatgtggccaaagttttacacaattgaaaataaagtaaaacagacggcatgtgtttaaacctgagtttatcaggcatggcaggaagttgcaggagagagaggcagtgacccaagccagtgcacttgatgttcatggacatatattttttttaaataataaattaaaacattttaaatagaagcataaattgagttgtttgttggcgctgagatactgcccactgtgaaacaaagctttgactagttttttgtttgtttactttcttcaggggggaggggggcaagtttgggtaggaaagaaagcataaatgaacgtgaccctgaggtgaagaggtatatgaacagcctttgcaatgtacaaaaagaaaaaaaaacaaaaaacaacaaaaaaaatagagcaagtgaaaccaaaaatgatgttcttggtgtttttctataatgtagtcttgttagcttttttgttactgtaacaatgctgatctcgaactgtaccaaaatacatggagactaacaaacagaaccacatggaactttcaaactgaaaaaaaaatttgtcacaaaaactttgttgtcatagttaagttgattgtagatggtaattgaatatactcctttgaaaatatttcatcaagtatgtttcctgctcattgtgatacattaaaaaaaaaatatgagcaaaa

SEQ ID NO: 34781 - DNA, 9671 bp, Homo sapiens
aatttaaagtggtctctattcgaagtctctgctctttcacttaaacctttactctaagctgtccccctccactaatgcccccattctttggagatgctcttttcctagttaatttaaacattgctgcgtttgcttagagagagagagagagagagagagagagagagagagagaaaggggaaaataataagaaagaaaagagaagggggggaagaagaaaggaaaaaaaaaatcttaaaaagattcttagccaggttcctattgttgctcctatgcattccacttctcggtgtgtgtgtgcgtgtgtgtgtgtgtgtgtgtgtgtgcgcgcgctcgtgtgtgtgtcgtgtgtgtgtgtgtgtgtgtttttaatacatgcataaacttttggagcctctctccctcttctaggctcttctcccatcctctcttcctgctctccttgccctgctcatcactttcccctgtttttttttttttttcctcccttcctcccctctgcctccctccacctcccccttttcttttttgctgaatcttattgatccagaaggtggctaattagcccttcccgtcgtgcctgggtaatgaagcacatgcgcactgaattaatcacagccattttttgcaggaaactaattagcagaataaagatccaaagacttttttttcttttcactcatcagctcccacttccagcgcgtcccctccgaccgctgcagccgccaccgccgccgcctcctcctcctcctcctcccggccgcagccgccgccgccgcctgctttgcatcccaattacagcctagagccgctgccgccgccgccgccgcttctcttccgtggcccctgcccgctccgggggctgtaaactccccgccaaccatgctgctcggcggcagcggcggcggcggctccggctccccggctgcggccgcctcccgccccgggctccgccgagcgcgctccagctccgccgccgccgccgccgccgccgccgccgccagcagcgcgtcctccgccgccgccgacccccgccagccgccgctgctgccttgatgggctccgcggcccgagcgcctcttttcgggattaaaagcgccgccagctcccgccgccgccgccgtcgccagcagcgccgctgcagccgccgccgccggagaagcaaccgctgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtgaccacccctgagatggtgatgccaagcagcatgttcctcccagcagctgttccagatcgagatgggaattccaatttggaagaggcaggaaagcagcctgaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggcagaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgacaactgagaccctgctgcaactacagcagcagcagcacctcctcttccctttctacatccccagtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggagatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcggcaactacagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaa

SEQ ID NO: 34782 - DNA, 11091 bp, Homo sapiens
atttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactggggcaaatagcaaactcttttctacagcgatgttcctggactccctggcatctgctggagagaagagtgatcagtctgcttctgcacctatgtcgttctacccacagatcatcaacacttttcatatcgcttcatccctcgggaaaccatttacagccgatcaggctttcccaaatacctcagcattagcaggagttggtcctgtgttgcacagtttccgtgtctatgatctccgacacaagagagagaaagactatctaaccagtgatggctcagccaaaaactcctgtgtgtccaaagatgtccctaacaatgtggacttgtccaaattcgatggttgtgttagcgatgggaaaaggaaacctgttttaatgtgtttcttgtgcaagttgtcttttggttatatcaggtcatttgtaacccatgctgtgcatgatcatcggatgaccctcaatgacgaggagcagaagctcctcagtaataaatgcgtctccgccataatacaggggattggcaaagacaaagaacctcttataagctttctggaaccaaaaaaatccacttctgtttatccccatttttctactacaaacctcataggacccgatccaaccttccgcggtttatggagcgcttttcatgttgaaaatggtgactctttgccggctggctttgccttcttaaaaggaagcgcgagcacctcgagctcagcagagcagccgctggggattacccaaatgccaaaggctgaagtgaatctgggggggctgtctagtttagtagtgaacaccccaattacctctgtctccctcagccactcatcgtctgagtctagcaagatgtcagagagcaaagaccaagagaacaactgtgaaaggccaaaagaaagcaacgttttacacccaaacggggagtgccctgtcaaaagtgaacccactgaaccgggagatgaggatgaagaagatgcgtactccaatgaacttgatgacgaggaagtattaggtgaactcaccgatagtattggtaacaaagatttccctctcttaaaccaaagcatttctcctttatcatccagtgtgctaaaatttattgaaaagggtacctcgtcctcctcggcgactgtttctgatgacacagaaaagaaaaaacagactgctgctgttagggccagtggcagtgttgctagtaactatggcatcagtggcaaggactttgcagacgcaagtgccagtaaagacagtgccacagctgctcatccaagtgaaatagcccggggagacgaagacagttcagccactcctcaccagcatggctttaccccgagtactcctggcacaccagggcctggaggagacggctcaccgggcagtggcatcgagtgtccaaagtgcgacactgtgttggggtcttcgaggtctcttggtggtcatatgactatgatgcactcgaggaactcatgcaaaaccctcaaatgtcctaaatgtaactggcactacaaatatcagcagaccctggaggcccatatgaaggagaaacaccctgagccgggtggctcttgtgtttattgtaagactggacagcctcaccccaggcttgcccggggtgagagttacacgtgtggctataaacccttccgttgtgaggtttgtaactactctaccactaccaaaggcaacctcagtattcatatgcagtcggacaagcacctgaacaatgttcagaatctccaaaatggcaatggtgagcaggtgtttggccactctgccccagcccccaacaccagcctcagtggctgcggaacaccctctccgtccaaacccaaacagaaacccacctggcggtgtgaagtttgtgattatgaaaccaatgtcgccaggaacctccgaattcatatgaccagcgaaaagcacatgcataatatgatgcttttgcagcagaacatgaagcagatccagcataatctgcacttgggcctcgccccggcggaagcagagctttatcagtactacctagcccagaacataggcctgaccggaatgaagctggaaaaccctgccgaccctcagctgatgatcaatccattccagctggatccagcgacagcagcggctttggcaccagggctcggagagctgtcaccttatatcagtgacccagcgctgaagctattccagtgtgctgtttgcaacaaattcacctctgacagcctggaggccctaagtgtgcatgtgagcagtgagcgctctctccctgaagaggaatggagggcagtaattggagatatctaccagtgcaagctctgcaactacaacactcagctcaaagccaacttccagctacactgcaagactgataaacatatgcagaaatatcaactggtggctcacattaaagaagggggcaaaagcaatgagtggaggttgaagtgtattgccattggcaaccctgttcacctaaaatgtaacgcctgtgactattacaccaacagtgtggataaattacgcttgcataccaccaatcacaggcacgaggcggccctgaagctctacaagcacttgcagaagcaagagggtgcagtgaatcccgaatcctgctattactactgtgccgtgtgtgattacaccaccaaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcatgaggaggcagaaggagctattaagcctacagcagtggccgaggacgatgaaaaagacacaagtgagagagacaatagtgaaggcaaaaactctaataaagactctgttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttatgacagtgcctgtccctgatgtgatgatgccaaacagtatgctactgccagcagctgcctctgagaaatcagagcgggacacacctgcagccgtgacagctgaggggtctgggaaatattcaggtgaaagtccaatggatgacaaaagcatggcaggtctcgaggattcaaaggctaatgtggaagtaaagaatgaggagcagaaaccgactaaagaacccttggaagtctcagaatggaataaaaatagcagtaaggatgtgaaaatccccgacacactgcaagatcaattaaatgaacagcaaaaaaggcaaccgctctctgtttctgaccgtcatgtctacaagtatcgctgtaaccattgtagcttggctttcaaaactatgcagaagcttcagatacattcccagtatcatgcaattcgggctgcgacaatgtgtaacctctgccagcgcagtttccgtacattccaggctttaaaaaaacacttggaagcaggccaccctgaactgagtgaagctgaacttcaacagctatatgcctccttgcccgtgaatggagaactgtgggcagagagcgaaactatgtcccaggatgaccatggcctagagcaggaaatggagagagagtatgaggtggaccacgaagggaaagcaagtcctgtaggaagtgatagtagctctattccagatgacatgggctctgaaccaaagcggaccttaccttttagaaaagggcccaattttacgatggaaaaattccttgatccatctcgtccatataaatgtacagtgtgtaaagagtcattcacccaaaagaacattctcttggtccactataattcagtttctcacttgcataagctgaaaaaagttttgcaggaagcctccagtcctgtcccacaagaaaccaacagcaacacagataacaaaccctacaagtgcagcatctgcaatgttgcatacagccaaagctcaacattggaaatccacatgaggtctgtgctccaccagacaaaggctagggctgcaaagctggagcccagtggtcatgtggctggtgggcacagcattgcagcaaatgtcaacagccctggccaggggatgttagattccatgagtttagcagctgtaaacagcaaagatacccatttagatgccaaagaattaaataaaaagcaaactcctgatttaatctctgctcaacctgcacatcacccaccacagtcaccagcacaaattcagatgcaactacagcacgaattacaacagcaagccgcattctttcagcctcagtttctaaacccagcctttttgcctcattttcctatgaccccagaagcactgctgcagtttcagcagcctcagtttctctttccattttatatacctgggacggagttcagcttggggccagatttgggcttgccaggctctgccacatttgggatgcctggcatgacaggaatggctggctccttgcttgaagacctaaagcagcagattcaaacccaacatcacgttggtcaaactcaactccagatactacagcaacaagcacaacaataccaagccacacagccccagctgcagcctcaaaaacaacagcagcagccaccacctccacagcagcagcagcaacagcaggcaagcaaattattgaaacaagagcaaagtaacatagtgagtgcagactgccaaatcatgaaggatgtgccatcttataaggaggcagaagatatttctgaaaagccagaaaaaccaaagcaggaatttataagtgaaggtgaaggactcaaagaaggcaaagacacaaagaagcaaaaatccttggaaccatccatcccaccaccccgaatagcttcaggggccagaggaaatgctgccaaagcgttattggaaaactttggttttgaactggtcattcagtataacgaaaacaggcagaaggtacagaagaagggcaaaagtggtgaaggcgaaaacactgacaaactagaatgtggaacatgtggtaaattgttttccaatgttcttattttaaagagtcaccaagaacatgtacatgggcaattttttccatatgcagcgctagaaaaatttgctcgtcaatacagggaggcctatgacaagctttatccaatttctccatcttctccagaaacgccgcccccgccacctcctcctcctcccttgcctccggctcctccacagccttcttctatgggtcctgtaaagatccccaacacggtttctactcctctgcaagctccaccacccactcctcccccaccaccaccacctcctcctcctcctcctcctccccccccacctcctccaccttctgctcctccacaggtccaactgccggtttctctggacctgccgctctttccttccattatgatgcaacctgtgcaacaccctgcgcttcctccccagcttgccctgcagctgccacagatggacgcactctctgcagacctcacccaactttgccagcagcagctcggattagatcccaacttcttaagacattctcagttcaaacgcccacggacaagaattacagatgatcagctaaaaatcctgagggcttattttgacattaataattctccaagtgaagaacagatccaggaaatggcagagaaatctggcctctcccaaaaagttatcaaacactggtttagaaatacgctttttaaggaacgacagagaaataaagattcaccatacaacttcagtaaccctcctataacggttttagaagatatcagaattgatccacagcccacctctttagaacattacaaatctgatgcatcattcagtaaaaggtcttctagaacgagatttactgactaccagcttagggttctgcaagacttttttgacacaaacgcttacccaaaagatgatgaaatagaacaactctccactgttctcaatctgcctacccgggttattgttgtatggttccagaatgctcgtcagaaagcacgaaagagttatgagaatcaagcagaaacaaaagataatgaaaaaagagaactcactaatgaacggtacattcgaacaagcaacatgcagtaccagtgtaaaaagtgcaatgtggttttccccaggatctttgacttgattacgcatcagaaaaagcagtgttacaaggatgaagatgatgatgcccaagatgaaagccaaacagaagactccatggatgccactgatcaagtggtatacaagcattgcacagtgtctggccaaacggatgcagctaaaaacgctgctgcccctgcagcaagttctggctctgggaccagcacccccctgattccatcacccaaaccagaacctgagaagacttctccaaaacctgaatatcccgcagaaaagccaaagcagagtgacccctctcccccttctcaaggcaccaaaccagccctgccattagcatcgacttcctcggacccaccacaggcatccacagcccagccacagccacagccacagccaccaaaacaaccccaacttatcggaagacctccctcggcctctcaaacaccggtcccttccagtccactgcaaatttccatgacgtctctccagaacagtctacctccacagttactacaataccaatgtgatcagtgtacagttgccttcccaactctggaactctggcaggaacaccagcacatgcacttccttgctgctcaaaaccaattccttcactctccgttcttggaaaggcccatggacatgccctacatgatatttgaccccaacaatccgctgatgactggacaactgctgggcagttccctcactcaaatgccccctcaggccagttcctcccacaccacagcccccacaacggttgctgcttccctaaaaaggaaactagacgataaagaagataataattgcagtgaaaaagaaggagggaatagcggtgaagaccaacaccgagataaacgcttgagaaccacgatcaccccggaacagctggaaatactctatgaaaaatacttgctggattccaatcctaccagaaaaatgcttgatcatattgcccgcgaagtcgggctgaaaaaaagggtcgtgcaagtctggttccagaatacacgagcgcgggagaggaaaggccagttccgggcggtgggtccagcacagtctcataaacggtgtccgttttgccgagccctgtttaaagcaaagtcggccttagaaagccacattcgctctcggcactggaatgaaggaaagcaggcaggttacagcttgccaccaagccctttaatatccaccgaagatgggggagaaagcccacagaaatacatctattttgattacccatctttgccattaactaaaattgatctatcaagtgagaatgaattggcttctacagtgtcaacacctgttagtaaaacagcagagctgtcaccgaagaatcttttaagcccttcttcttttaaagcagagtgttctgaggatgtagagaatttaaatgcccctcctgctgaggctgggtatgatcaaaataaaaccgattttgatgagacttcatcgattaatacggcaatcagtgacgccaccaccggagacgagggaaacactgaaatggaaagcaccacaggaagttccggagatgtgaaaccggctttgtctcccaaagagccaaaaactctggatactctgccaaaacctgcaaccacacctaccacggaggtctgcgatgacaaatttctcttttctctcacaagcccatccatccatttcaatgacaaagatggcgaccacgaccaaagcttttacatcacagatgacccggatgacaacgccgaccgcagcgaaacgtccagcatagcggacccgagctccccaaatccattcggatccagcaatccctttaaatccaaaagtaatgatcggccgggtcacaagcgttttcgaacgcaaatgagcaatcttcaactcaaggttctcaaggcttgctttagtgactaccgaactccaaccatgcaagaatgtgaaatgttagggaatgagattggtctgcccaaacgcgtagtccaggtgtggttccaaaatgcaagggcaaaggaaaagaaatttaaaattaacatagggaagcctttcatgatcaatcaaggcggaacggaaggcaccaaaccagagtgtaccctctgcggggtgaagtactctgcccgcttgtccatcagagatcacattttctccaaacagcacatttcaaaagtgagggagaccgttggcagtcagctcgatcgggagaaagattacttggctccgaccacggttcggcagctgatggcacagcaagaacttgatcgtataaagaaagcttcagacgtgctgggcttgacggtacagcagccaggcatgatggacagcagttctctccacggcatcagcctgccaacagcctaccccggactccccggccttcctccagtccttctccccggaatgaacggtccatcctccttgccgggatttccacaaaattcaaacatagcatcaggcatgcttgggtttcctacttcagctacttcgtctcctgccctgtctctcagcagtgcccccaccaaacctttgctgcagactccaccacctccaccacctcctcctcctcctcctccttcatcctctctgtcaggacagcagaccgagcaacagaacaaagaatctgagaaaaagcaaactaagccaaacaaggtgaaaaaaatcaaagaggaggaattagaggccaccaaacccgaaaaacaccccaaaaaagaggaaaaaatctcatctgctctttcagtgttgggcaaagttgtaggtgaaacacatgtcgatcctattcagttgcaggcattacagaatgcaattgctggtgacccagcttcctttataggcggacagttcttgccatactttatccctgggtttgcttcttattttacacctcagctccctggaacagtgcaggggggatacttcccacctgtctgtggcatggagagcctctttccttatggccctacaatgccccagacactggcaggtctgtccccaggtgcactgttgcagcagtaccaacagtatcagcagaacctgcaggagtccctgcaaaagcagcaaaagcaacagcaagaacagcagcagaaaccagttcaggcaaagacatccaaagtagaaagtgaccagccgcaaaactccaacgatgcttcagaaacaaaggaagacaaaagtactgctacagaaagcacaaaagaagaaccccagttagaatccaaaagtgcagacttttcagacacttacgttgttccattcgtcaagtatgagtttatatgcagaaagtgccagatgatgtttactgatgaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacacctccagtcaagcttgcacaaagagaaaacaatcaaacaagcaatgagaaatgccaaagagcatgttagattattacctcactcagtctgctcccctaatcctaacaccacatctacctcgcagtctgcagcttcttctaataacacctatcctcatctttcttgcttctccatgaagtcctggcctaatatccttttccaagcgtctgccaggagagctgcttctcccccttcttctcctccttccctttccttgccttcaacggttacctcaagtttgtgcagcacctcaggggttcaaacctcactacccacagaaagttgttcagatgagtctgacagtgagctgagccagaagctagaagacttagataattctttggaagtgaaggctaagcctgcttctggcctagatggtaatttcaatagcatccgaatggatatgttcagtgtgtag

SEQ ID NO: 34783 - DNA, 13909 bp, Homo sapiens
atttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactggggcaaatagcaaactcttttctacagcgatgttcctggactccctggcatctgctggagagaagagtgatcagtctgcttctgcacctatgtcgttctacccacagatcatcaacacttttcatatcgcttcatccctcgggaaaccatttacagccgatcaggctttcccaaatacctcagcattagcaggagttggtcctgtgttgcacagtttccgtgtctatgatctccgacacaagagagagaaagactatctaaccagtgatggctcagccaaaaactcctgtgtgtccaaagatgtccctaacaatgtggacttgtccaaattcgatggttgtgttagcgatgggaaaaggaaacctgttttaatgtgtttcttgtgcaagttgtcttttggttatatcaggtcatttgtaacccatgctgtgcatgatcatcggatgaccctcaatgacgaggagcagaagctcctcagtaataaatgcgtctccgccataatacaggggattggcaaagacaaagaacctcttataagctttctggaaccaaaaaaatccacttctgtttatccccatttttctactacaaacctcataggacccgatccaaccttccgcggtttatggagcgcttttcatgttgaaaatggtgactctttgccggctggctttgccttcttaaaaggaagcgcgagcacctcgagctcagcagagcagccgctggggattacccaaatgccaaaggctgaagtgaatctgggggggctgtctagtttagtagtgaacaccccaattacctctgtctccctcagccactcatcgtctgagtctagcaagatgtcagagagcaaagaccaagagaacaactgtgaaaggccaaaagaaagcaacgttttacacccaaacggggagtgccctgtcaaaagtgaacccactgaaccgggagatgaggatgaagaagatgcgtactccaatgaacttgatgacgaggaagtattaggtgaactcaccgatagtattggtaacaaagatttccctctcttaaaccaaagcatttctcctttatcatccagtgtgctaaaatttattgaaaagggtacctcgtcctcctcggcgactgtttctgatgacacagaaaagaaaaaacagactgctgctgttagggccagtggcagtgttgctagtaactatggcatcagtggcaaggactttgcagacgcaagtgccagtaaagacagtgccacagctgctcatccaagtgaaatagcccggggagacgaagacagttcagccactcctcaccagcatggctttaccccgagtactcctggcacaccagggcctggaggagacggctcaccgggcagtggcatcgagtgtccaaagtgcgacactgtgttggggtcttcgaggtctcttggtggtcatatgactatgatgcactcgaggaactcatgcaaaaccctcaaatgtcctaaatgtaactggcactacaaatatcagcagaccctggaggcccatatgaaggagaaacaccctgagccgggtggctcttgtgtttattgtaagactggacagcctcaccccaggcttgcccggggtgagagttacacgtgtggctataaacccttccgttgtgaggtttgtaactactctaccactaccaaaggcaacctcagtattcatatgcagtcggacaagcacctgaacaatgttcagaatctccaaaatggcaatggtgagcaggtgtttggccactctgccccagcccccaacaccagcctcagtggctgcggaacaccctctccgtccaaacccaaacagaaacccacctggcggtgtgaagtttgtgattatgaaaccaatgtcgccaggaacctccgaattcatatgaccagcgaaaagcacatgcataatatgatgcttttgcagcagaacatgaagcagatccagcataatctgcacttgggcctcgccccggcggaagcagagctttatcagtactacctagcccagaacataggcctgaccggaatgaagctggaaaaccctgccgaccctcagctgatgatcaatccattccagctggatccagcgacagcagcggctttggcaccagggctcgtaaataatgagctgccgcctgaaatccggcttgccagtggtcagctaatgggtgatgacctgtccctccttactgcaggagagctgtcaccttatatcagtgacccagcgctgaagctattccagtgtgctgtttgcaacaaattcacctctgacagcctggaggccctaagtgtgcatgtgagcagtgagcgctctctccctgaagaggaatggagggcagtaattggagatatctaccagtgcaagctctgcaactacaacactcagctcaaagccaacttccagctacactgcaagactgataaacatatgcagaaatatcaactggtggctcacattaaagaagggggcaaaagcaatgagtggaggttgaagtgtattgccattggcaaccctgttcacctaaaatgtaacgcctgtgactattacaccaacagtgtggataaattacgcttgcataccaccaatcacaggcacgaggcggccctgaagctctacaagcacttgcagaagcaagagggtgcagtgaatcccgaatcctgctattactactgtgccgtgtgtgattacaccaccaaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcagttgagatcgacctcagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttatgacagtgcctgtccctgatgtgatgatgccaaacagtatgctactgccagcagctgcctctgagaaatcagagcgggacacacctgcagccgtgacagctgaggggtctgggaaatattcaggtgaaagtccaatggatgacaaaagcatggcaggtctcgaggattcaaaggctaatgtggaagtaaagaatgaggagcagaaaccgactaaagaacccttggaagtctcagaatggaataaaaatagcagtaaggatgtgaaaatccccgacacactgcaagatcaattaaatgaacagcaaaaaaggcaaccgctctctgtttctgaccgtcatgtctacaagtatcgctgtaaccattgtagcttggctttcaaaactatgcagaagcttcagatacattcccagtatcatgcaattcgggctgcgacaatgtgtaacctctgccagcgcagtttccgtacattccaggctttaaaaaaacacttggaagcaggccaccctgaactgagtgaagctgaacttcaacagctatatgcctccttgcccgtgaatggagaactgtgggcagagagcgaaactatgtcccaggatgaccatggcctagagcaggaaatggagagagagtatgaggtggaccacgaagggaaagcaagtcctgtaggaagtgatagtagctctattccagatgacatgggctctgaaccaaagcggaccttaccttttagaaaagggcccaattttacgatggaaaaattccttgatccatctcgtccatataaatgtacagtgtgtaaagagtcattcacccaaaagaacattctcttggtccactataattcagtttctcacttgcataagctgaaaaaagttttgcaggaagcctccagtcctgtcccacaagaaaccaacagcaacacagataacaaaccctacaagtgcagcatctgcaatgttgcatacagccaaagctcaacattggaaatccacatgaggtctgtgctccaccagacaaaggctagggctgcaaagctggagcccagtggtcatgtggctggtgggcacagcattgcagcaaatgtcaacagccctggccaggggatgttagattccatgagtttagcagctgtaaacagcaaagatacccatttagatgccaaagaattaaataaaaagcaaactcctgatttaatctctgctcaacctgcacatcacccaccacagtcaccagcacaaattcagatgcaactacagcacgaattacaacagcaagccgcattctttcagcctcagtttctaaacccagcctttttgcctcattttcctatgaccccagaagcactgctgcagtttcagcagcctcagtttctctttccattttatatacctgggacggagttcagcttggggccagatttgggcttgccaggctctgccacatttgggatgcctggcatgacaggaatggctggctccttgcttgaagacctaaagcagcagattcaaacccaacatcacgttggtcaaactcaactccagatactacagcaacaagcacaacaataccaagccacacagccccagctgcagcctcaaaaacaacagcagcagccaccacctccacagcagcagcagcaacagcaggcaagcaaattattgaaacaagagcaaagtaacatagtgagtgcagactgccaaatcatgaaggatgtgccatcttataaggaggcagaagatatttctgaaaagccagaaaaaccaaagcaggaatttataagtgaaggtgaaggactcaaagaaggcaaagacacaaagaagcaaaaatccttggaaccatccatcccaccaccccgaatagcttcaggggccagaggaaatgctgccaaagcgttattggaaaactttggttttgaactggtcattcagtataacgaaaacaggcagaaggtacagaagaagggcaaaagtggtgaaggcgaaaacactgacaaactagaatgtggaacatgtggtaaattgttttccaatgttcttattttaaagagtcaccaagaacatgtacatgggcaattttttccatatgcagcgctagaaaaatttgctcgtcaatacagggaggcctatgacaagctttatccaatttctccatcttctccagaaacgccgcccccgccacctcctcctcctcccttgcctccggctcctccacagccttcttctatgggtcctgtaaagatccccaacacggtttctactcctctgcaagctccaccacccactcctcccccaccttctgctcctccacaggtccaactgccggtttctctggacctgccgctctttccttccattatgatgcaacctgtgcaacaccctgcgcttcctccccagcttgccctgcagctgccacagatggacgcactctctgcagacctcacccaactttgccagcagcagctcggattagatcccaacttcttaagacattctcagttcaaacgcccacggacaagaattacagatgatcagctaaaaatcctgagggcttattttgacattaataattctccaagtgaagaacagatccaggaaatggcagagaaatctggcctctcccaaaaagttatcaaacactggtttagaaatacgctttttaaggaacgacagagaaataaagattcaccatacaacttcagtaaccctcctataacggttttagaagatatcagaattgatccacagcccacctctttagaacattacaaatctgatgcatcattcagtaaaaggtcttctagaacgagatttactgactaccagcttagggttctgcaagacttttttgacacaaacgcttacccaaaagatgatgaaatagaacaactctccactgttctcaatctgcctacccgggttattgttgtatggttccagaatgctcgtcagaaagcacgaaagagttatgagaatcaagcagaaacaaaagataatgaaaaaagagaactcactaatgaacggtacattcgaacaagcaacatgcagtaccagtgtaaaaagtgcaatgtggttttccccaggatctttgacttgattacgcatcagaaaaagcagtgttacaaggatgaagatgatgatgcccaagatgaaagccaaacagaagactccatggatgccactgatcaagtggtatacaagcattgcacagtgtctggccaaacggatgcagctaaaaacgctgctgcccctgcagcaagttctggctctgggaccagcacccccctgattccatcacccaaaccagaacctgagaagacttctccaaaacctgaatatcccgcagaaaagccaaagcagagtgacccctctcccccttctcaaggcaccaaaccagccctgccattagcatcgacttcctcggacccaccacaggcatccacagcccagccacagccacagccacagccaccaaaacaaccccaacttatcggaagacctccctcggcctctcaaacaccggtcccttccagtccactgcaaatttccatgacgtctctccagaacagtctacctccacagttactacaataccaatgtgatcagtgtacagttgccttcccaactctggaactctggcaggaacaccagcacatgcacttccttgctgctcaaaaccaattccttcactctccgttcttggaaaggcccatggacatgccctacatgatatttgaccccaacaatccgctgatgactggacaactgctgggcagttccctcactcaaatgccccctcaggccagttcctcccacaccacagcccccacaacggttgctgcttccctaaaaaggaaactagacgataaagaagataataattgcagtgaaaaagaaggagggaatagcggtgaagaccaacaccgagataaacgcttgagaaccacgatcaccccggaacagctggaaatactctatgaaaaatacttgctggattccaatcctaccagaaaaatgcttgatcatattgcccgcgaagtcgggctgaaaaaaagggtcgtgcaagtctggttccagaatacacgagcgcgggagaggaaaggccagttccgggcggtgggtccagcacagtctcataaacggtgtccgttttgccgagccctgtttaaagcaaagtcggccttagaaagccacattcgctctcggcactggaatgaaggaaagcaggcaggttacagcttgccaccaagccctttaatatccaccgaagatgggggagaaagcccacagaaatacatctattttgattacccatctttgccattaactaaaattgatctatcaagtgagaatgaattggcttctacagtgtcaacacctgttagtaaaacagcagagctgtcaccgaagaatcttttaagcccttcttcttttaaagcagagtgttctgaggatgtagagaatttaaatgcccctcctgctgaggctgggtatgatcaaaataaaaccgattttgatgagacttcatcgattaatacggcaatcagtgacgccaccaccggagacgagggaaacactgaaatggaaagcaccacaggaagttccggagatgtgaaaccggctttgtctcccaaagagccaaaaactctggatactctgccaaaacctgcaaccacacctaccacggaggtctgcgatgacaaatttctcttttctctcacaagcccatccatccatttcaatgacaaagatggcgaccacgaccaaagcttttacatcacagatgacccggatgacaacgccgaccgcagcgaaacgtccagcatagcggacccgagctccccaaatccattcggatccagcaatccctttaaatccaaaagtaatgatcggccgggtcacaagcgttttcgaacgcaaatgagcaatcttcaactcaaggttctcaaggcttgctttagtgactaccgaactccaaccatgcaagaatgtgaaatgttagggaatgagattggtctgcccaaacgcgtagtccaggtgtggttccaaaatgcaagggcaaaggaaaagaaatttaaaattaacatagggaagcctttcatgatcaatcaaggcggaacggaaggcaccaaaccagagtgtaccctctgcggggtgaagtactctgcccgcttgtccatcagagatcacattttctccaaacagcacatttcaaaagtgagggagaccgttggcagtcagctcgatcgggagaaagattacttggctccgaccacggttcggcagctgatggcacagcaagaacttgatcgtataaagaaagcttcagacgtgctgggcttgacggtacagcagccaggcatgatggacagcagttctctccacggcatcagcctgccaacagcctaccccggactccccggccttcctccagtccttctccccggaatgaacggtccatcctccttgccgggatttccacaaaattcaaacactttaacacctcccggtgcaggcatgcttgggtttcctacttcagctacttcgtctcctgccctgtctctcagcagtgcccccaccaaacctttgctgcagactccaccacctccaccacctcctcctcctcctcctccttcatcctctctgtcaggacagcagaccgagcaacagaacaaagaatctgagaaaaagcaaactaagccaaacaaggtgaaaaaaatcaaagaggaggaattagaggccaccaaacccgaaaaacaccccaaaaaagaggaaaaaatctcatctgctctttcagtgttgggcaaagttgtaggtgaaacacatgtcgatcctattcagttgcaggcattacagaatgcaattgctggtgacccagcttcctttataggcggacagttcttgccatactttatccctgggtttgcttcttattttacacctcagctccctggaacagtgcaggggggatacttcccacctgtctgtggcatggagagcctctttccttatggccctacaatgccccagacactggcaggtctgtccccaggtgcactgttgcagcagtaccaacagtatcagcagaacctgcaggagtccctgcaaaagcagcaaaagcaacagcaagaacagcagcagaaaccagttcaggcaaagacatccaaagtagaaagtgaccagccgcaaaactccaacgatgcttcagaaacaaaggaagacaaaagtactgctacagaaagcacaaaagaagaaccccagttagaatccaaaagtgcagacttttcagacacttacgttgttccattcgtcaagtatgagtttatatgcagaaagtgccagatgatgtttactgatgaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacacctccagtcaagcttgcacaaagagaaaacaatcaaacaagcaatgagaaatgccaaagagcatgttagattattacctcactcagtctgctcccctaatcctaacaccacatctacctcgcagtctgcagcttcttctaataacacctatcctcatctttcttgcttctccatgaagtcctggcctaatatccttttccaagcgtctgccaggagagctgcttctcccccttcttctcctccttccctttccttgccttcaacggttacctcaagtttgtgcagcacctcaggggttcaaacctcactacccacagaaagttgttcagatgagtctgacagtgagctgagccagaagctagaagacttagataattctttggaagtgaaggctaagcctgcttctggcctagatggtaatttcaatagcatccgaatggatatgttcagtgtgtaggagtgaagacaggatcccgtgcttaaaaaaataaaaaataaaaaaataaaaaaaaaataagactttaactgcagttccaaagcttctctaacccaaaaattacagtaccaaatgattgactcaggattgtttttcccatattgatatgctggcaatataggatggtatgtaatggacagaactgatgcagatggttgaatgcgcttgtactatatgctaaaatatggaaaaggaaaaaaaaatctcacaagttcttttggaacttgtttcaagccaaaaactctcaagaaagcaaattgcacctcagctggattgatttccaaatgctagcatgtactgtatgggaggatgatccagatgtttcaaagagaatttctcttagtttagttaggtgtaattcagtagctttaaattctcaggtcagaacataacatttctcatttgttaaaagcagcaagaagcctggtaaaactgtgacttttccccaaacgtcaatctttattagaaagcattttctaggtgtgtttagtgtacaaagagactttataacccttactggacaacacacagatccttgagctcacgctgcaggatagtacagttttaccgcagagggaatctggaacagtggaatcatgtgtctgccctgtgtattgcagtttgtattgccacaagctatatttataccagtgtcacccttttcttgtagaatatactaataatctgtgccaactctaccttctcacttttacctctgacgtcattctttttttctgaaagaggtaataattctagttttgatagactctgaggattatgtgaacaggacatttttcatttgtgaatttaatgctatactgtcaaggtacttgcttgtgtctgaactctagtgcacttatgattttgtagaccatgtgaaatttaataagataccttttttttcctttctttgtgtgtagtgcagcaacagtttggtctgcatttgttagaagtttaactcctaacaacccaaagacctatttaacaattggtgcataaatgaaagtagtactgtatacttgaaactgtttaagtacaagttgaacaaaaattatgaaaaggtatatttgcttctcgggaaagcaaagaagctgctttaaaaaataaaaaggggactaaaaatttgttttgtataaagaggttagccctgcgcacgtaggactgaattcagtgatatccctatacactgccatttagtggataggttattgtacttccattcatactctgggcacttgtgttgtattgttctgttacatactttttttaacctgttttgttttatcatatatgcattaaaagtattatctttatcaacatttgctgctactgtgttaacatttttgttttgcttgccatgaatttcaacttccaccacccagtgaattgatttataaattgctatgctttgctgtttttctgttgctgtggaacttaaagaatgtgaaagctgtcaaagggtattttacgaatcacttttgtgtttgatatagtaaaacaatgtgattcattccaaagtaacagaaggttatttgtaagaaagttaaaggcttgtgaacaaagaaagctaagctgttgtacatatttgtagttggctgtgcatggtacaaatttattaatatgaagaaatgcaaaatgtattgcttttgatatttctcttccgagatgaacaagtagcatgtaatgcaactgtttgacagtttaactcaagtcatgcttcaaactgttttaatgatcaaatcaagacacatttcattttacattttattattgtacagtttttgtttcggatgatgatcacagcaatctttattctatacattttatgtgaacttttttaatgtctttaatttggattttttttttttttagtattttaacatttattttaatcctgaagacacttttttgattgtgtttcgtaagagacaacatggcctcctaaggtgcaatcctgccgctatagtgagctaatgtcctgaatccaaaggcttcagaaaattgcttttgcctttttcatgaatgttaagcagcagcattgtgagatcgatctgtcctggcagttaacacgatgtgcaacagtgtgttagcatggaacagaacgcttttcacaaaacaaaggactgttttacaaatgattattccgacagtgtgtcgacataaacttttacaactgcacagcagccaaaaaaagaaaaaaaaaagaaaaaaaactttaactggatggacgttgttagggtgagaaataaaaggacagcctccaaaggttgagaatgagaattgttttttcctggatatcaaagggattatcacagcgcaatcattgtctacacaacatgtactctcaacgcctgggttacataggaaatgcaccctgaggttttaataaaagcccctatggctataactttaaataaactaaaccaaaaatgttattgatgttttatatatagagagtagtctcattagtttttgttactgtaatgtttgaagtctcaaatgcaccgtattacggtaaataacatggttttgaaaacttttttttattttgtcacagacctgttgtcatagttgaaatgatgtttattgtagatggtatttgaacttattcttctggaaatagttcatcaagtatgtttgttgctcattgtgatacattaaaaactgtatctacatattt

SEQ ID NO: 34784 - DNA, 13822 bp, Homo sapiens
atttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactggggcaaatagcaaactcttttctacagcgatgttcctggactccctggcatctgctggagagaagagtgatcagtctgcttctgcacctatgtcgttctacccacagatcatcaacacttttcatatcgcttcatccctcgggaaaccatttacagccgatcaggctttcccaaatacctcagcattagcaggagttggtcctgtgttgcacagtttccgtgtctatgatctccgacacaagagagagaaagactatctaaccagtgatggctcagccaaaaactcctgtgtgtccaaagatgtccctaacaatgtggacttgtccaaattcgatggttgtgttagcgatgggaaaaggaaacctgttttaatgtgtttcttgtgcaagttgtcttttggttatatcaggtcatttgtaacccatgctgtgcatgatcatcggatgaccctcaatgacgaggagcagaagctcctcagtaataaatgcgtctccgccataatacaggggattggcaaagacaaagaacctcttataagctttctggaaccaaaaaaatccacttctgtttatccccatttttctactacaaacctcataggacccgatccaaccttccgcggtttatggagcgcttttcatgttgaaaatggtgactctttgccggctggctttgccttcttaaaaggaagcgcgagcacctcgagctcagcagagcagccgctggggattacccaaatgccaaaggctgaagtgaatctgggggggctgtctagtttagtagtgaacaccccaattacctctgtctccctcagccactcatcgtctgagtctagcaagatgtcagagagcaaagaccaagagaacaactgtgaaaggccaaaagaaagcaacgttttacacccaaacggggagtgccctgtcaaaagtgaacccactgaaccgggagatgaggatgaagaagatgcgtactccaatgaacttgatgacgaggaagtattaggtgaactcaccgatagtattggtaacaaagatttccctctcttaaaccaaagcatttctcctttatcatccagtgtgctaaaatttattgaaaagggtacctcgtcctcctcggcgactgtttctgatgacacagaaaagaaaaaacagactgctgctgttagggccagtggcagtgttgctagtaactatggcatcagtggcaaggactttgcagacgcaagtgccagtaaagacagtgccacagctgctcatccaagtgaaatagcccggggagacgaagacagttcagccactcctcaccagcatggctttaccccgagtactcctggcacaccagggcctggaggagacggctcaccgggcagtggcatcgagtgtccaaagtgcgacactgtgttggggtcttcgaggtctcttggtggtcatatgactatgatgcactcgaggaactcatgcaaaaccctcaaatgtcctaaatgtaactggcactacaaatatcagcagaccctggaggcccatatgaaggagaaacaccctgagccgggtggctcttgtgtttattgtaagactggacagcctcaccccaggcttgcccggggtgagagttacacgtgtggctataaacccttccgttgtgaggtttgtaactactctaccactaccaaaggcaacctcagtattcatatgcagtcggacaagcacctgaacaatgttcagaatctccaaaatggcaatggtgagcaggtgtttggccactctgccccagcccccaacaccagcctcagtggctgcggaacaccctctccgtccaaacccaaacagaaacccacctggcggtgtgaagtttgtgattatgaaaccaatgtcgccaggaacctccgaattcatatgaccagcgaaaagcacatgcataatatgatgcttttgcagcagaacatgaagcagatccagcataatctgcacttgggcctcgccccggcggaagcagagctttatcagtactacctagcccagaacataggcctgaccggaatgaagctggaaaaccctgccgaccctcagctgatgatcaatccattccagctggatccagcgacagcagcggctttggcaccagggctcggagagctgtcaccttatatcagtgacccagcgctgaagctattccagtgtgctgtttgcaacaaattcacctctgacagcctggaggccctaagtgtgcatgtgagcagtgagcgctctctccctgaagaggaatggagggcagtaattggagatatctaccagtgcaagctctgcaactacaacactcagctcaaagccaacttccagctacactgcaagactgataaacatatgcagaaatatcaactggtggctcacattaaagaagggggcaaaagcaatgagtggaggttgaagtgtattgccattggcaaccctgttcacctaaaatgtaacgcctgtgactattacaccaacagtgtggataaattacgcttgcataccaccaatcacaggcacgaggcggccctgaagctctacaagcacttgcagaagcaagagggtgcagtgaatcccgaatcctgctattactactgtgccgtgtgtgattacaccaccaaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcatgaggaggcagaaggagctattaagcctacagcagtggccgaggacgatgaaaaagacacaagtgagagagacaatagtgaaggcaaaaactctaataaagactctgttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttatgacagtgcctgtccctgatgtgatgatgccaaacagtatgctactgccagcagctgcctctgagaaatcagagcgggacacacctgcagccgtgacagctgaggggtctgggaaatattcaggtgaaagtccaatggatgacaaaagcatggcaggtctcgaggattcaaaggctaatgtggaagtaaagaatgaggagcagaaaccgactaaagaacccttggaagtctcagaatggaataaaaatagcagtaaggatgtgaaaatccccgacacactgcaagatcaattaaatgaacagcaaaaaaggcaaccgctctctgtttctgaccgtcatgtctacaagtatcgctgtaaccattgtagcttggctttcaaaactatgcagaagcttcagatacattcccagtatcatgcaattcgggctgcgacaatgtgtaacctctgccagcgcagtttccgtacattccaggctttaaaaaaacacttggaagcaggccaccctgaactgagtgaagctgaacttcaacagctatatgcctccttgcccgtgaatggagaactgtgggcagagagcgaaactatgtcccaggatgaccatggcctagagcaggaaatggagagagagtatgaggtggaccacgaagggaaagcaagtcctgtaggaagtgatagtagctctattccagatgacatgggctctgaaccaaagcggaccttaccttttagaaaagggcccaattttacgatggaaaaattccttgatccatctcgtccatataaatgtacagtgtgtaaagagtcattcacccaaaagaacattctcttggtccactataattcagtttctcacttgcataagctgaaaaaagttttgcaggaagcctccagtcctgtcccacaagaaaccaacagcaacacagataacaaaccctacaagtgcagcatctgcaatgttgcatacagccaaagctcaacattggaaatccacatgaggtctgtgctccaccagacaaaggctagggctgcaaagctggagcccagtggtcatgtggctggtgggcacagcattgcagcaaatgtcaacagccctggccaggggatgttagattccatgagtttagcagctgtaaacagcaaagatacccatttagatgccaaagaattaaataaaaagcaaactcctgatttaatctctgctcaacctgcacatcacccaccacagtcaccagcacaaattcagatgcaactacagcacgaattacaacagcaagccgcattctttcagcctcagtttctaaacccagcctttttgcctcattttcctatgaccccagaagcactgctgcagtttcagcagcctcagtttctctttccattttatatacctgggacggagttcagcttggggccagatttgggcttgccaggctctgccacatttgggatgcctggcatgacaggaatggctggctccttgcttgaagacctaaagcagcagattcaaacccaacatcacgttggtcaaactcaactccagatactacagcaacaagcacaacaataccaagccacacagccccagctgcagcctcaaaaacaacagcagcagccaccacctccacagcagcagcagcaacagcaggcaagcaaattattgaaacaagagcaaagtaacatagtgagtgcagactgccaaatcatgaaggatgtgccatcttataaggaggcagaagatatttctgaaaagccagaaaaaccaaagcaggaatttataagtgaaggtgaaggactcaaagaaggcaaagacacaaagaagcaaaaatccttggaaccatccatcccaccaccccgaatagcttcaggggccagaggaaatgctgccaaagcgttattggaaaactttggttttgaactggtcattcagtataacgaaaacaggcagaaggtacagaagaagggcaaaagtggtgaaggcgaaaacactgacaaactagaatgtggaacatgtggtaaattgttttccaatgttcttattttaaagagtcaccaagaacatgtacatgggcaattttttccatatgcagcgctagaaaaatttgctcgtcaatacagggaggcctatgacaagctttatccaatttctccatcttctccagaaacgccgcccccgccacctcctcctcctcccttgcctccggctcctccacagccttcttctatgggtcctgtaaagatccccaacacggtttctactcctctgcaagctccaccacccactcctcccccaccaccaccacctcctcctcctcctcctcctccccccccacctcctccaccttctgctcctccacaggtccaactgccggtttctctggacctgccgctctttccttccattatgatgcaacctgtgcaacaccctgcgcttcctccccagcttgccctgcagctgccacagatggacgcactctctgcagacctcacccaactttgccagcagcagctcggattagatcccaacttcttaagacattctcagttcaaacgcccacggacaagaattacagatgatcagctaaaaatcctgagggcttattttgacattaataattctccaagtgaagaacagatccaggaaatggcagagaaatctggcctctcccaaaaagttatcaaacactggtttagaaatacgctttttaaggaacgacagagaaataaagattcaccatacaacttcagtaaccctcctataacggttttagaagatatcagaattgatccacagcccacctctttagaacattacaaatctgatgcatcattcagtaaaaggtcttctagaacgagatttactgactaccagcttagggttctgcaagacttttttgacacaaacgcttacccaaaagatgatgaaatagaacaactctccactgttctcaatctgcctacccgggttattgttgtatggttccagaatgctcgtcagaaagcacgaaagagttatgagaatcaagcagaaacaaaagataatgaaaaaagagaactcactaatgaacggtacattcgaacaagcaacatgcagtaccagtgtaaaaagtgcaatgtggttttccccaggatctttgacttgattacgcatcagaaaaagcagtgttacaaggatgaagatgatgatgcccaagatgaaagccaaacagaagactccatggatgccactgatcaagtggtatacaagcattgcacagtgtctggccaaacggatgcagctaaaaacgctgctgcccctgcagcaagttctggctctgggaccagcacccccctgattccatcacccaaaccagaacctgagaagacttctccaaaacctgaatatcccgcagaaaagccaaagcagagtgacccctctcccccttctcaaggcaccaaaccagccctgccattagcatcgacttcctcggacccaccacaggcatccacagcccagccacagccacagccacagccaccaaaacaaccccaacttatcggaagacctccctcggcctctcaaacaccggtcccttccagtccactgcaaatttccatgacgtctctccagaacagtctacctccacagttactacaataccaatgtgatcagtgtacagttgccttcccaactctggaactctggcaggaacaccagcacatgcacttccttgctgctcaaaaccaattccttcactctccgttcttggaaaggcccatggacatgccctacatgatatttgaccccaacaatccgctgatgactggacaactgctgggcagttccctcactcaaatgccccctcaggccagttcctcccacaccacagcccccacaacggttgctgcttccctaaaaaggaaactagacgataaagaagataataattgcagtgaaaaagaaggagggaatagcggtgaagaccaacaccgagataaacgcttgagaaccacgatcaccccggaacagctggaaatactctatgaaaaatacttgctggattccaatcctaccagaaaaatgcttgatcatattgcccgcgaagtcgggctgaaaaaaagggtcgtgcaagtctggttccagaatacacgagcgcgggagaggaaaggccagttccgggcggtgggtccagcacagtctcataaacggtgtccgttttgccgagccctgtttaaagcaaagtcggccttagaaagccacattcgctctcggcactggaatgaaggaaagcaggcaggttacagcttgccaccaagccctttaatatccaccgaagatgggggagaaagcccacagaaatacatctattttgattacccatctttgccattaactaaaattgatctatcaagtgagaatgaattggcttctacagtgtcaacacctgttagtaaaacagcagagctgtcaccgaagaatcttttaagcccttcttcttttaaagcagagtgttctgaggatgtagagaatttaaatgcccctcctgctgaggctgggtatgatcaaaataaaaccgattttgatgagacttcatcgattaatacggcaatcagtgacgccaccaccggagacgagggaaacactgaaatggaaagcaccacaggaagttccggagatgtgaaaccggctttgtctcccaaagagccaaaaactctggatactctgccaaaacctgcaaccacacctaccacggaggtctgcgatgacaaatttctcttttctctcacaagcccatccatccatttcaatgacaaagatggcgaccacgaccaaagcttttacatcacagatgacccggatgacaacgccgaccgcagcgaaacgtccagcatagcggacccgagctccccaaatccattcggatccagcaatccctttaaatccaaaagtaatgatcggccgggtcacaagcgttttcgaacgcaaatgagcaatcttcaactcaaggttctcaaggcttgctttagtgactaccgaactccaaccatgcaagaatgtgaaatgttagggaatgagattggtctgcccaaacgcgtagtccaggtgtggttccaaaatgcaagggcaaaggaaaagaaatttaaaattaacatagggaagcctttcatgatcaatcaaggcggaacggaaggcaccaaaccagagtgtaccctctgcggggtgaagtactctgcccgcttgtccatcagagatcacattttctccaaacagcacatttcaaaagtgagggagaccgttggcagtcagctcgatcgggagaaagattacttggctccgaccacggttcggcagctgatggcacagcaagaacttgatcgtataaagaaagcttcagacgtgctgggcttgacggtacagcagccaggcatgatggacagcagttctctccacggcatcagcctgccaacagcctaccccggactccccggccttcctccagtccttctccccggaatgaacggtccatcctccttgccgggatttccacaaaattcaaacactttaacacctcccggtgcaggcatgcttgggtttcctacttcagctacttcgtctcctgccctgtctctcagcagtgcccccaccaaacctttgctgcagactccaccacctccaccacctcctcctcctcctcctccttcatcctctctgtcaggacagcagaccgagcaacagaacaaagaatctgagaaaaagcaaactaagccaaacaaggtgaaaaaaatcaaagaggaggaattagaggccaccaaacccgaaaaacaccccaaaaaagaggaaaaaatctcatctgctctttcagtgttgggcaaagttgtaggtgaaacacatgtcgatcctattcagttgcaggcattacagaatgcaattgctggtgacccagcttcctttataggcggacagttcttgccatactttatccctgggtttgcttcttattttacacctcagctccctggaacagtgcaggggggatacttcccacctgtctgtggcatggagagcctctttccttatggccctacaatgccccagacactggcaggtctgtccccaggtgcactgttgcagcagtaccaacagtatcagcagaacctgcaggagtccctgcaaaagcagcaaaagcaacagcaagaacagcagcagaaaccagttcaggcaaagacatccaaagtagaaagtgaccagccgcaaaactccaacgatgcttcagaaacaaaggaagacaaaagtactgctacagaaagcacaaaagaagaaccccagttagaatccaaaagtgcagacttttcagacacttacgttgttccattcgtcaagtatgagtttatatgcagaaagtgccagatgatgtttactgatgaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacacctccagtcaagcttgcacaaagagaaaacaatcaaacaagcaatgagaaatgccaaagagcatgttagattattacctcactcagtctgctcccctaatcctaacaccacatctacctcgcagtctgcagcttcttctaataacacctatcctcatctttcttgcttctccatgaagtcctggcctaatatccttttccaagcgtctgccaggagagctgcttctcccccttcttctcctccttccctttccttgccttcaacggttacctcaagtttgtgcagcacctcaggggttcaaacctcactacccacagaaagttgttcagatgagtctgacagtgagctgagccagaagctagaagacttagataattctttggaagtgaaggctaagcctgcttctggcctagatggtaatttcaatagcatccgaatggatatgttcagtgtgtaggagtgaagacaggatcccgtgcttaaaaaaataaaaaataaaaaaataaaaaaaaaataagactttaactgcagttccaaagcttctctaacccaaaaattacagtaccaaatgattgactcaggattgtttttcccatattgatatgctggcaatataggatggtatgtaatggacagaactgatgcagatggttgaatgcgcttgtactatatgctaaaatatggaaaaggaaaaaaaaatctcacaagttcttttggaacttgtttcaagccaaaaactctcaagaaagcaaattgcacctcagctggattgatttccaaatgctagcatgtactgtatgggaggatgatccagatgtttcaaagagaatttctcttagtttagttaggtgtaattcagtagctttaaattctcaggtcagaacataacatttctcatttgttaaaagcagcaagaagcctggtaaaactgtgacttttccccaaacgtcaatctttattagaaagcattttctaggtgtgtttagtgtacaaagagactttataacccttactggacaacacacagatccttgagctcacgctgcaggatagtacagttttaccgcagagggaatctggaacagtggaatcatgtgtctgccctgtgtattgcagtttgtattgccacaagctatatttataccagtgtcacccttttcttgtagaatatactaataatctgtgccaactctaccttctcacttttacctctgacgtcattctttttttctgaaagaggtaataattctagttttgatagactctgaggattatgtgaacaggacatttttcatttgtgaatttaatgctatactgtcaaggtacttgcttgtgtctgaactctagtgcacttatgattttgtagaccatgtgaaatttaataagataccttttttttcctttctttgtgtgtagtgcagcaacagtttggtctgcatttgttagaagtttaactcctaacaacccaaagacctatttaacaattggtgcataaatgaaagtagtactgtatacttgaaactgtttaagtacaagttgaacaaaaattatgaaaaggtatatttgcttctcgggaaagcaaagaagctgctttaaaaaataaaaaggggactaaaaatttgttttgtataaagaggttagccctgcgcacgtaggactgaattcagtgatatccctatacactgccatttagtggataggttattgtacttccattcatactctgggcacttgtgttgtattgttctgttacatactttttttaacctgttttgttttatcatatatgcattaaaagtattatctttatcaacatttgctgctactgtgttaacatttttgttttgcttgccatgaatttcaacttccaccacccagtgaattgatttataaattgctatgctttgctgtttttctgttgctgtggaacttaaagaatgtgaaagctgtcaaagggtattttacgaatcacttttgtgtttgatatagtaaaacaatgtgattcattccaaagtaacagaaggttatttgtaagaaagttaaaggcttgtgaacaaagaaagctaagctgttgtacatatttgtagttggctgtgcatggtacaaatttattaatatgaagaaatgcaaaatgtattgcttttgatatttctcttccgagatgaacaagtagcatgtaatgcaactgtttgacagtttaactcaagtcatgcttcaaactgttttaatgatcaaatcaagacacatttcattttacattttattattgtacagtttttgtttcggatgatgatcacagcaatctttattctatacattttatgtgaacttttttaatgtctttaatttggattttttttttttttagtattttaacatttattttaatcctgaagacacttttttgattgtgtttcgtaagagacaacatggcctcctaaggtgcaatcctgccgctatagtgagctaatgtcctgaatccaaaggcttcagaaaattgcttttgcctttttcatgaatgttaagcagcagcattgtgagatcgatctgtcctggcagttaacacgatgtgcaacagtgtgttagcatggaacagaacgcttttcacaaaacaaaggactgttttacaaatgattattccgacagtgtgtcgacataaacttttacaactgcacagcagccaaaaaaagaaaaaaaaaagaaaaaaaactttaactggatggacgttgttagggtgagaaataaaaggacagcctccaaaggttgagaatgagaattgttttttcctggatatcaaagggattatcacagcgcaatcattgtctacacaacatgtactctcaacgcctgggttacataggaaatgcaccctgaggttttaataaaagcccctatggctataactttaaataaactaaaccaaaaatgttattgatgttttatatatagagagtagtctcattagtttttgttactgtaatgtttgaagtctcaaatgcaccgtattacggtaaataacatggttttgaaaacttttttttattttgtcacagacctgttgtcatagttgaaatgatgtttattgtagatggtatttgaacttattcttctggaaatagttcatcaagtatgtttgttgctcattgtgatacattaaaaactgtatctacatattt

SEQ ID NO: 34785 - DNA, 613 bp, Homo sapiens
atagcacaatccccttgtttaaccaatacggaaaccaaagctcatggaaattcctgggaaacatcacataactacagagtgcagctgaagaaattgagtgtgtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactgggg

SEQ ID NO: 34786 - DNA, 12175 bp, Homo sapiens
ccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactggggcaaatagcaaactcttttctacagcgatgttcctggactccctggcatctgctggagagaagagtgatcagtctgcttctgcacctatgtcgttctacccacagatcatcaacacttttcatatcgcttcatccctcgggaaaccatttacagccgatcaggctttcccaaatacctcagcattagcaggagttggtcctgtgttgcacagtttccgtgtctatgatctccgacacaagagagagaaagactatctaaccagtgatggctcagccaaaaactcctgtgtgtccaaagatgtccctaacaatgtggacttgtccaaattcgatggttgtgttagcgatgggaaaaggaaacctgttttaatgtgtttcttgtgcaagttgtcttttggttatatcaggtcatttgtaacccatgctgtgcatgatcatcggatgaccctcaatgacgaggagcagaagctcctcagtaataaatgcgtctccgccataatacaggggattggcaaagacaaagaacctcttataagctttctggaaccaaaaaaatccacttctgtttatccccatttttctactacaaacctcataggacccgatccaaccttccgcggtttatggagcgcttttcatgttgaaaatggtgactctttgccggctggctttgccttcttaaaaggaagcgcgagcacctcgagctcagcagagcagccgctggggattacccaaatgccaaaggctgaagtgaatctgggggggctgtctagtttagtagtgaacaccccaattacctctgtctccctcagccactcatcgtctgagtctagcaagatgtcagagagcaaagaccaagagaacaactgtgaaaggccaaaagaaagcaacgttttacacccaaacggggagtgccctgtcaaaagtgaacccactgaaccgggagatgaggatgaagaagatgcgtactccaatgaacttgatgacgaggaagtattaggtgaactcaccgatagtattggtaacaaagatttccctctcttaaaccaaagcatttctcctttatcatccagtgtgctaaaatttattgaaaagggtacctcgtcctcctcggcgactgtttctgatgacacagaaaagaaaaaacagactgctgctgttagggccagtggcagtgttgctagtaactatggcatcagtggcaaggactttgcagacgcaagtgccagtaaagacagtgccacagctgctcatccaagtgaaatagcccggggagacgaagacagttcagccactcctcaccagcatggctttaccccgagtactcctggcacaccagggcctggaggagacggctcaccgggcagtggcatcgagtgtccaaagtgcgacactgtgttggggtcttcgaggtctcttggtggtcatatgactatgatgcactcgaggaactcatgcaaaaccctcaaatgtcctaaatgtaactggcactacaaatatcagcagaccctggaggcccatatgaaggagaaacaccctgagccgggtggctcttgtgtttattgtaagactggacagcctcaccccaggcttgcccggggtgagagttacacgtgtggctataaacccttccgttgtgaggtttgtaactactctaccactaccaaaggcaacctcagtattcatatgcagtcggacaagcacctgaacaatgttcagaatctccaaaatggcaatggtgagcaggtgtttggccactctgccccagcccccaacaccagcctcagtggctgcggaacaccctctccgtccaaacccaaacagaaacccacctggcggtgtgaagtttgtgattatgaaaccaatgtcgccaggaacctccgaattcatatgaccagcgaaaagcacatgcataatatgatgcttttgcagcagaacatgaagcagatccagcataatctgcacttgggcctcgccccggcggaagcagagctttatcagtactacctagcccagaacataggcctgaccggaatgaagctggaaaaccctgccgaccctcagctgatgatcaatccattccagctggatccagcgacagcagcggctttggcaccagggctcggagagctgtcaccttatatcagtgacccagcgctgaagctattccagtgtgctgtttgcaacaaattcacctctgacagcctggaggccctaagtgtgcatgtgagcagtgagcgctctctccctgaagaggaatggagggcagtaattggagatatctaccagtgcaagctctgcaactacaacactcagctcaaagccaacttccagctacactgcaagactgataaacatatgcagaaatatcaactggtggctcacattaaagaagggggcaaaagcaatgagtggaggttgaagtgtattgccattggcaaccctgttcacctaaaatgtaacgcctgtgactattacaccaacagtgtggataaattacgcttgcataccaccaatcacaggcacgaggcggccctgaagctctacaagcacttgcagaagcaagagggtgcagtgaatcccgaatcctgctattactactgtgccgtgtgtgattacaccaccaaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcagttgagatcgacctcagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttatgacagtgcctgtccctgatgtgatgatgccaaacagtatgctactgccagcagctgcctctgagaaatcagagcgggacacacctgcagccgtgacagctgaggggtctgggaaatattcaggtgaaagtccaatggatgacaaaagcatggcaggtctcgaggattcaaaggctaatgtggaagtaaagaatgaggagcagaaaccgactaaagaacccttggaagtctcagaatggaataaaaatagcagtaaggatgtgaaaatccccgacacactgcaagatcaattaaatgaacagcaaaaaaggcaaccgctctctgtttctgaccgtcatgtctacaagtatcgctgtaaccattgtagcttggctttcaaaactatgcagaagcttcagatacattcccagtatcatgcaattcgggctgcgacaatgtgtaacctctgccagcgcagtttccgtacattccaggctttaaaaaaacacttggaagcaggccaccctgaactgagtgaagctgaacttcaacagctatatgcctccttgcccgtgaatggagaactgtgggcagagagcgaaactatgtcccaggatgaccatggcctagagcaggaaatggagagagagtatgaggtggaccacgaagggaaagcaagtcctgtaggaagtgatagtagctctattccagatgacatgggctctgaaccaaagcggaccttaccttttagaaaagggcccaattttacgatggaaaaattccttgatccatctcgtccatataaatgtacagtgtgtaaagagtcattcacccaaaagaacattctcttggtccactataattcagtttctcacttgcataagctgaaaaaagttttgcaggaagcctccagtcctgtcccacaagaaaccaacagcaacacagataacaaaccctacaagtgcagcatctgcaatgttgcatacagccaaagctcaacattggaaatccacatgaggtctgtgctccaccagacaaaggctagggctgcaaagctggagcccagtggtcatgtggctggtgggcacagcattgcagcaaatgtcaacagccctggccaggggatgttagattccatgagtttagcagctgtaaacagcaaagatacccatttagatgccaaagaattaaataaaaagcaaactcctgatttaatctctgctcaacctgcacatcacccaccacagtcaccagcacaaattcagatgcaactacagcacgaattacaacagcaagccgcattctttcagcctcagtttctaaacccagcctttttgcctcattttcctatgaccccagaagcactgctgcagtttcagcagcctcagtttctctttccattttatatacctgggacggagttcagcttggggccagatttgggcttgccaggctctgccacatttgggatgcctggcatgacaggaatggctggctccttgcttgaagacctaaagcagcagattcaaacccaacatcacgttggtcaaactcaactccagatactacagcaacaagcacaacaataccaagccacacagccccagctgcagcctcaaaaacaacagcagcagccaccacctccacagcagcagcagcaacagcaggcaagcaaattattgaaacaagagcaaagtaacatagtgagtgcagactgccaaatcatgaaggatgtgccatcttataaggaggcagaagatatttctgaaaagccagaaaaaccaaagcaggaatttataagtgaaggtgaaggactcaaagaaggcaaagacacaaagaagcaaaaatccttggaaccatccatcccaccaccccgaatagcttcaggggccagaggaaatgctgccaaagcgttattggaaaactttggttttgaactggtcattcagtataacgaaaacaggcagaaggtacagaagaagggcaaaagtggtgaaggcgaaaacactgacaaactagaatgtggaacatgtggtaaattgttttccaatgttcttattttaaagagtcaccaagaacatgtacatgggcaattttttccatatgcagcgctagaaaaatttgctcgtcaatacagggaggcctatgacaagctttatccaatttctccatcttctccagaaacgccgcccccgccacctcctcctcctcccttgcctccggctcctccacagccttcttctatgggtcctgtaaagatccccaacacggtttctactcctctgcaagctccaccacccactcctcccccaccaccaccacctcctcctcctcctcctcctccccccccacctcctccaccttctgctcctccacaggtccaactgccggtttctctggacctgccgctctttccttccattatgatgcaacctgtgcaacaccctgcgcttcctccccagcttgccctgcagctgccacagatggacgcactctctgcagacctcacccaactttgccagcagcagctcggattagatcccaacttcttaagacattctcagttcaaacgcccacggacaagaattacagatgatcagctaaaaatcctgagggcttattttgacattaataattctccaagtgaagaacagatccaggaaatggcagagaaatctggcctctcccaaaaagttatcaaacactggtttagaaatacgctttttaaggaacgacagagaaataaagattcaccatacaacttcagtaaccctcctataacggttttagaagatatcagaattgatccacagcccacctctttagaacattacaaatctgatgcatcattcagtaaaaggtcttctagaacgagatttactgactaccagcttagggttctgcaagacttttttgacacaaacgcttacccaaaagatgatgaaatagaacaactctccactgttctcaatctgcctacccgggttattgttgtatggttccagaatgctcgtcagaaagcacgaaagagttatgagaatcaagcagaaacaaaagataatgaaaaaagagaactcactaatgaacggtacattcgaacaagcaacatgcagtaccagtgtaaaaagtgcaatgtggttttccccaggatctttgacttgattacgcatcagaaaaagcagtgttacaaggatgaagatgatgatgcccaagatgaaagccaaacagaagactccatggatgccactgatcaagtggtatacaagcattgcacagtgtctggccaaacggatgcagctaaaaacgctgctgcccctgcagcaagttctggctctgggaccagcacccccctgattccatcacccaaaccagaacctgagaagacttctccaaaacctgaatatcccgcagaaaagccaaagcagagtgacccctctcccccttctcaaggcaccaaaccagccctgccattagcatcgacttcctcggacccaccacaggcatccacagcccagccacagccacagccacagccaccaaaacaaccccaacttatcggaagacctccctcggcctctcaaacaccggtcccttccagtccactgcaaatttccatgacgtctctccagaacagtctacctccacagttactacaataccaatgtgatcagtgtacagttgccttcccaactctggaactctggcaggaacaccagcacatgcacttccttgctgctcaaaaccaattccttcactctccgttcttggaaaggcccatggacatgccctacatgatatttgaccccaacaatccgctgatgactggacaactgctgggcagttccctcactcaaatgccccctcaggccagttcctcccacaccacagcccccacaacggttgctgcttccctaaaaaggaaactagacgataaagaagataataattgcagtgaaaaagaaggagggaatagcggtgaagaccaacaccgagataaacgcttgagaaccacgatcaccccggaacagctggaaatactctatgaaaaatacttgctggattccaatcctaccagaaaaatgcttgatcatattgcccgcgaagtcgggctgaaaaaaagggtcgtgcaagtctggttccagaatacacgagcgcgggagaggaaaggccagttccgggcggtgggtccagcacagtctcataaacggtgtccgttttgccgagccctgtttaaagcaaagtcggccttagaaagccacattcgctctcggcactggaatgaaggaaagcaggcaggttacagcttgccaccaagccctttaatatccaccgaagatgggggagaaagcccacagaaatacatctattttgattacccatctttgccattaactaaaattgatctatcaagtgagaatgaattggcttctacagtgtcaacacctgttagtaaaacagcagagctgtcaccgaagaatcttttaagcccttcttcttttaaagcagagtgttctgaggatgtagagaatttaaatgcccctcctgctgaggctgggtatgatcaaaataaaaccgattttgatgagacttcatcgattaatacggcaatcagtgacgccaccaccggagacgagggaaacactgaaatggaaagcaccacaggaagttccggagatgtgaaaccggctttgtctcccaaagagccaaaaactctggatactctgccaaaacctgcaaccacacctaccacggaggtctgcgatgacaaatttctcttttctctcacaagcccatccatccatttcaatgacaaagatggcgaccacgaccaaagcttttacatcacagatgacccggatgacaacgccgaccgcagcgaaacgtccagcatagcggacccgagctccccaaatccattcggatccagcaatccctttaaatccaaaagtaatgatcggccgggtcacaagcgttttcgaacgcaaatgagcaatcttcaactcaaggttctcaaggcttgctttagtgactaccgaactccaaccatgcaagaatgtgaaatgttagggaatgagattggtctgcccaaacgcgtagtccaggtgtggttccaaaatgcaagggcaaaggaaaagaaatttaaaattaacatagggaagcctttcatgatcaatcaaggcggaacggaaggcaccaaaccagagtgtaccctctgcggggtgaagtactctgcccgcttgtccatcagagatcacattttctccaaacagcacatttcaaaagtgagggagaccgttggcagtcagctcgatcgggagaaagattacttggctccgaccacggttcggcagctgatggcacagcaagaacttgatcgtataaagaaagcttcagacgtgctgggcttgacggtacagcagccaggcatgatggacagcagttctctccacggcatcagcctgccaacagcctaccccggactccccggccttcctccagtccttctccccggaatgaacggtccatcctccttgccgggatttccacaaaattcaaacactttaacacctcccggtgcaggcatgcttgggtttcctacttcagctacttcgtctcctgccctgtctctcagcagtgcccccaccaaacctttgctgcagactccaccacctccaccacctcctcctcctcctcctccttcatcctctctgtcaggacagcagaccgagcaacagaacaaagaatctgagaaaaagcaaactaagccaaacaaggtgaaaaaaatcaaagaggaggaattagaggccaccaaacccgaaaaacaccccaaaaaagaggaaaaaatctcatctgctctttcagtgttgggcaaagttgtaggtgaaacacatgtcgatcctattcagttgcaggcattacagaatgcaattgctggtgacccagcttcctttataggcggacagttcttgccatactttatccctgggtttgcttcttattttacacctcagctccctggaacagtgcaggggggatacttcccacctgtctgtggcatggagagcctctttccttatggccctacaatgccccagacactggcaggtctgtccccaggtgcactgttgcagcagtaccaacagtatcagcagaacctgcaggagtccctgcaaaagcagcaaaagcaacagcaagaacagcagcagaaaccagttcaggcaaagacatccaaagtagaaagtgaccagccgcaaaactccaacgatgcttcagaaacaaaggaagacaaaagtactgctacagaaagcacaaaagaagaaccccagttagaatccaaaagtgcagacttttcagacacttacgttgttccattcgtcaagtatgagtttatatgcagaaagtgccagatgatgtttactgatgaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacacctccagtcaagcttgcacaaagagaaaacaatcaaacaagcaatgagaaatgccaaagagcatgttagattattacctcactcagtctgctcccctaatcctaacaccacatctacctcgcagtctgcagcttcttctaataacacctatcctcatctttcttgcttctccatgaagtcctggcctaatatccttttccaagcgtctgccaggagagctgcttctcccccttcttctcctccttccctttccttgccttcaacggttacctcaagtttgtgcagcacctcaggggttcaaacctcactacccacagaaagttgttcagatgagtctgacagtgagctgagccagaagctagaagacttagataattctttggaagtgaaggctaagcctgcttctggcctagatggtaatttcaatagcatccgaatggatatgttcagtgtgtaggagtgaagacaggatcccgtgcttaaaaaaataaaaaataaaaaaataaaaaaaaaataagactttaactgcagttccaaagcttctctaacccaaaaattacagtaccaaatgattgactcaggattgtttttcccatattgatatgctggcaatataggatggtatgtaatggacagaactgatgcagatggttgaatgcgcttgtactatatgctaaaatatggaaaaggaaaaaaaaatctcacaagttcttttggaacttgtttcaagccaaaaactctcaagaaagcaaattgcacctcagctggattgatttccaaatgctagcatgtactgtatgggaggatgatccagatgtttcaaagagaatttctcttagtttagttaggtgtaattcagtagctttaaattctcaggtcagaacataacatttctcatttgttaaaagcagcaagaagcctggtaaaactgtgacttttccccaaacgtcaatctttattagaaagcattttctaggtgtgtttagtgtacaaagagactttataacccttactggacaacacacagatccttgagctcacgctgcaggatagtacagttttaccgcagagggaatctggaacagtggaatcatgtgtctgccctgtgtattgcagtttgtattgccacaagctatatttataccagtgtcacccttttcttgtagaatatactaataatctgtgccaactctaccttctcacttttacctctgacgtcattctttttttctgaaagaggtaataattctagttttgatagactctgaggattatgtgaacaggacatttttcatttgtgaatttaatgctatactgtcaaggtacttgcttgtgtctgaactctagtgcacttatgattttgtagaccatgtgaaatttaataagataccttttttttcctttctttgtgtgtagtgcagcaacagtttggtctgcatttgttagaagtttaactcctaacaacccaaagacctatttaacaattggtgcataaatgaaagtagtactgtatacttgaaactgtttaagtacaagttgaacaaaaattatgaaaaggtatatttgcttctcgggaaagcaaagaagctgctttaaaaaataaaaaggggactaaaaatttgttttgtataaagaggttagccctgcgcacgtaggactgaattcagtgatatccctatacactgccatttagtggataggttattgtacttccattcatactctgggcacttgtgttgtattgttctgttacatactttttttaacctgttttgttttatcatatatgcattaaaagtattatctttatcaaca

SEQ ID NO: 34787 - DNA, 618 bp, Homo sapiens
atcgcccggcctctgggccagggacccgcgaggcggcggctgcttgctccgaacggaacgccgccgggtgtgcgttagaccagcggatagacgcccgcggcttggggtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactgggg

SEQ ID NO: 34788 - DNA, 14019 bp, Homo sapiens
attcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactggggcaaatagcaaactcttttctacagcgatgttcctggactccctggcatctgctggagagaagagtgatcagtctgcttctgcacctatgtcgttctacccacagatcatcaacacttttcatatcgcttcatccctcgggaaaccatttacagccgatcaggctttcccaaatacctcagcattagcaggagttggtcctgtgttgcacagtttccgtgtctatgatctccgacacaagagagagaaagactatctaaccagtgatggctcagccaaaaactcctgtgtgtccaaagatgtccctaacaatgtggacttgtccaaattcgatggttgtgttagcgatgggaaaaggaaacctgttttaatgtgtttcttgtgcaagttgtcttttggttatatcaggtcatttgtaacccatgctgtgcatgatcatcggatgaccctcaatgacgaggagcagaagctcctcagtaataaatgcgtctccgccataatacaggggattggcaaagacaaagaacctcttataagctttctggaaccaaaaaaatccacttctgtttatccccatttttctactacaaacctcataggacccgatccaaccttccgcggtttatggagcgcttttcatgttgaaaatggtgactctttgccggctggctttgccttcttaaaaggaagcgcgagcacctcgagctcagcagagcagccgctggggattacccaaatgccaaaggctgaagtgaatctgggggggctgtctagtttagtagtgaacaccccaattacctctgtctccctcagccactcatcgtctgagtctagcaagatgtcagagagcaaagaccaagagaacaactgtgaaaggccaaaagaaagcaacgttttacacccaaacggggagtgccctgtcaaaagtgaacccactgaaccgggagatgaggatgaagaagatgcgtactccaatgaacttgatgacgaggaagtattaggtgaactcaccgatagtattggtaacaaagatttccctctcttaaaccaaagcatttctcctttatcatccagtgtgctaaaatttattgaaaagggtacctcgtcctcctcggcgactgtttctgatgacacagaaaagaaaaaacagactgctgctgttagggccagtggcagtgttgctagtaactatggcatcagtggcaaggactttgcagacgcaagtgccagtaaagacagtgccacagctgctcatccaagtgaaatagcccggggagacgaagacagttcagccactcctcaccagcatggctttaccccgagtactcctggcacaccagggcctggaggagacggctcaccgggcagtggcatcgagtgtccaaagtgcgacactgtgttggggtcttcgaggtctcttggtggtcatatgactatgatgcactcgaggaactcatgcaaaaccctcaaatgtcctaaatgtaactggcactacaaatatcagcagaccctggaggcccatatgaaggagaaacaccctgagccgggtggctcttgtgtttattgtaagactggacagcctcaccccaggcttgcccggggtgagagttacacgtgtggctataaacccttccgttgtgaggtttgtaactactctaccactaccaaaggcaacctcagtattcatatgcagtcggacaagcacctgaacaatgttcagaatctccaaaatggcaatggtgagcaggtgtttggccactctgccccagcccccaacaccagcctcagtggctgcggaacaccctctccgtccaaacccaaacagaaacccacctggcggtgtgaagtttgtgattatgaaaccaatgtcgccaggaacctccgaattcatatgaccagcgaaaagcacatgcataatatgatgcttttgcagcagaacatgaagcagatccagcataatctgcacttgggcctcgccccggcggaagcagagctttatcagtactacctagcccagaacataggcctgaccggaatgaagctggaaaaccctgccgaccctcagctgatgatcaatccattccagctggatccagcgacagcagcggctttggcaccagggctcgtaaataatgagctgccgcctgaaatccggcttgccagtggtcagctaatgggtgatgacctgtccctccttactgcaggagagctgtcaccttatatcagtgacccagcgctgaagctattccagtgtgctgtttgcaacaaattcacctctgacagcctggaggccctaagtgtgcatgtgagcagtgagcgctctctccctgaagaggaatggagggcagtaattggagatatctaccagtgcaagctctgcaactacaacactcagctcaaagccaacttccagctacactgcaagactgataaacatatgcagaaatatcaactggtggctcacattaaagaagggggcaaaagcaatgagtggaggttgaagtgtattgccattggcaaccctgttcacctaaaatgtaacgcctgtgactattacaccaacagtgtggataaattacgcttgcataccaccaatcacaggcacgaggcggccctgaagctctacaagcacttgcagaagcaagagggtgcagtgaatcccgaatcctgctattactactgtgccgtgtgtgattacaccaccaaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcagttgagatcgacctcagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttatgacagtgcctgtccctgatgtgatgatgccaaacagtatgctactgccagcagctgcctctgagaaatcagagcgggacacacctgcagccgtgacagctgaggggtctgggaaatattcaggtgaaagtccaatggatgacaaaagcatggcaggtctcgaggattcaaaggctaatgtggaagtaaagaatgaggagcagaaaccgactaaagaacccttggaagtctcagaatggaataaaaatagcagtaaggatgtgaaaatccccgacacactgcaagatcaattaaatgaacagcaaaaaaggcaaccgctctctgtttctgaccgtcatgtctacaagtatcgctgtaaccattgtagcttggctttcaaaactatgcagaagcttcagatacattcccagtatcatgcaattcgggctgcgacaatgtgtaacctctgccagcgcagtttccgtacattccaggctttaaaaaaacacttggaagcaggccaccctgaactgagtgaagctgaacttcaacagctatatgcctccttgcccgtgaatggagaactgtgggcagagagcgaaactatgtcccaggatgaccatggcctagagcaggaaatggagagagagtatgaggtggaccacgaagggaaagcaagtcctgtaggaagtgatagtagctctattccagatgacatgggctctgaaccaaagcggaccttaccttttagaaaagggcccaattttacgatggaaaaattccttgatccatctcgtccatataaatgtacagtgtgtaaagagtcattcacccaaaagaacattctcttggtccactataattcagtttctcacttgcataagctgaaaaaagttttgcaggaagcctccagtcctgtcccacaagaaaccaacagcaacacagataacaaaccctacaagtgcagcatctgcaatgttgcatacagccaaagctcaacattggaaatccacatgaggtctgtgctccaccagacaaaggctagggctgcaaagctggagcccagtggtcatgtggctggtgggcacagcattgcagcaaatgtcaacagccctggccaggggatgttagattccatgagtttagcagctgtaaacagcaaagatacccatttagatgccaaagaattaaataaaaagcaaactcctgatttaatctctgctcaacctgcacatcacccaccacagtcaccagcacaaattcagatgcaactacagcacgaattacaacagcaagccgcattctttcagcctcagtttctaaacccagcctttttgcctcattttcctatgaccccagaagcactgctgcagtttcagcagcctcagtttctctttccattttatatacctgggacggagttcagcttggggccagatttgggcttgccaggctctgccacatttgggatgcctggcatgacaggaatggctggctccttgcttgaagacctaaagcagcagattcaaacccaacatcacgttggtcaaactcaactccagatactacagcaacaagcacaacaataccaagccacacagccccagctgcagcctcaaaaacaacagcagcagccaccacctccacagcagcagcagcaacagcaggcaagcaaattattgaaacaagagcaaagtaacatagtgagtgcagactgccaaatcatgaaggatgtgccatcttataaggaggcagaagatatttctgaaaagccagaaaaaccaaagcaggaatttataagtgaaggtgaaggactcaaagaaggcaaagacacaaagaagcaaaaatccttggaaccatccatcccaccaccccgaatagcttcaggggccagaggaaatgctgccaaagcgttattggaaaactttggttttgaactggtcattcagtataacgaaaacaggcagaaggtacagaagaagggcaaaagtggtgaaggcgaaaacactgacaaactagaatgtggaacatgtggtaaattgttttccaatgttcttattttaaagagtcaccaagaacatgtacatgggcaattttttccatatgcagcgctagaaaaatttgctcgtcaatacagggaggcctatgacaagctttatccaatttctccatcttctccagaaacgccgcccccgccacctcctcctcctcccttgcctccggctcctccacagccttcttctatgggtcctgtaaagatccccaacacggtttctactcctctgcaagctccaccacccactcctcccccaccaccaccacctcctcctcctcctcctcctccccccccacctcctccaccttctgctcctccacaggtccaactgccggtttctctggacctgccgctctttccttccattatgatgcaacctgtgcaacaccctgcgcttcctccccagcttgccctgcagctgccacagatggacgcactctctgcagacctcacccaactttgccagcagcagctcggattagatcccaacttcttaagacattctcagttcaaacgcccacggacaagaattacagatgatcagctaaaaatcctgagggcttattttgacattaataattctccaagtgaagaacagatccaggaaatggcagagaaatctggcctctcccaaaaagttatcaaacactggtttagaaatacgctttttaaggaacgacagagaaataaagattcaccatacaacttcagtaaccctcctataacggttttagaagatatcagaattgatccacagcccacctctttagaacattacaaatctgatgcatcattcagtaaaaggtcttctagaacgagatttactgactaccagcttagggttctgcaagacttttttgacacaaacgcttacccaaaagatgatgaaatagaacaactctccactgttctcaatctgcctacccgggttattgttgtatggttccagaatgctcgtcagaaagcacgaaagagttatgagaatcaagcagaaacaaaagataatgaaaaaagagaactcactaatgaacggtacattcgaacaagcaacatgcagtaccagtgtaaaaagtgcaatgtggttttccccaggatctttgacttgattacgcatcagaaaaagcagtgttacaaggatgaagatgatgatgcccaagatgaaagccaaacagaagactccatggatgccactgatcaagtggtatacaagcattgcacagtgtctggccaaacggatgcagctaaaaacgctgctgcccctgcagcaagttctggctctgggaccagcacccccctgattccatcacccaaaccagaacctgagaagacttctccaaaacctgaatatcccgcagaaaagccaaagcagagtgacccctctcccccttctcaaggcaccaaaccagccctgccattagcatcgacttcctcggacccaccacaggcatccacagcccagccacagccacagccacagccaccaaaacaaccccaacttatcggaagacctccctcggcctctcaaacaccggtcccttccagtccactgcaaatttccatgacgtctctccagaacagtctacctccacagttactacaataccaatgtgatcagtgtacagttgccttcccaactctggaactctggcaggaacaccagcacatgcacttccttgctgctcaaaaccaattccttcactctccgttcttggaaaggcccatggacatgccctacatgatatttgaccccaacaatccgctgatgactggacaactgctgggcagttccctcactcaaatgccccctcaggccagttcctcccacaccacagcccccacaacggttgctgcttccctaaaaaggaaactagacgataaagaagataataattgcagtgaaaaagaaggagggaatagcggtgaagaccaacaccgagataaacgcttgagaaccacgatcaccccggaacagctggaaatactctatgaaaaatacttgctggattccaatcctaccagaaaaatgcttgatcatattgcccgcgaagtcgggctgaaaaaaagggtcgtgcaagtctggttccagaatacacgagcgcgggagaggaaaggccagttccgggcggtgggtccagcacagtctcataaacggtgtccgttttgccgagccctgtttaaagcaaagtcggccttagaaagccacattcgctctcggcactggaatgaaggaaagcaggcaggttacagcttgccaccaagccctttaatatccaccgaagatgggggagaaagcccacagaaatacatctattttgattacccatctttgccattaactaaaattgatctatcaagtgagaatgaattggcttctacagtgtcaacacctgttagtaaaacagcagagctgtcaccgaagaatcttttaagcccttcttcttttaaagcagagtgttctgaggatgtagagaatttaaatgcccctcctgctgaggctgggtatgatcaaaataaaaccgattttgatgagacttcatcgattaatacggcaatcagtgacgccaccaccggagacgagggaaacactgaaatggaaagcaccacaggaagttccggagatgtgaaaccggctttgtctcccaaagagccaaaaactctggatactctgccaaaacctgcaaccacacctaccacggaggtctgcgatgacaaatttctcttttctctcacaagcccatccatccatttcaatgacaaagatggcgaccacgaccaaagcttttacatcacagatgacccggatgacaacgccgaccgcagcgaaacgtccagcatagcggacccgagctccccaaatccattcggatccagcaatccctttaaatccaaaagtaatgatcggccgggtcacaagcgttttcgaacgcaaatgagcaatcttcaactcaaggttctcaaggcttgctttagtgactaccgaactccaaccatgcaagaatgtgaaatgttagggaatgagattggtctgcccaaacgcgtagtccaggtgtggttccaaaatgcaagggcaaaggaaaagaaatttaaaattaacatagggaagcctttcatgatcaatcaaggcggaacggaaggcaccaaaccagagtgtaccctctgcggggtgaagtactctgcccgcttgtccatcagagatcacattttctccaaacagcacatttcaaaagtgagggagaccgttggcagtcagctcgatcgggagaaagattacttggctccgaccacggttcggcagctgatggcacagcaagaacttgatcgtataaagaaagcttcagacgtgctgggcttgacggtacagcagccaggcatgatggacagcagttctctccacggcatcagcctgccaacagcctaccccggactccccggccttcctccagtccttctccccggaatgaacggtccatcctccttgccgggatttccacaaaattcaaacactttaacacctcccggtgcaggcatgcttgggtttcctacttcagctacttcgtctcctgccctgtctctcagcagtgcccccaccaaacctttgctgcagactccaccacctccaccacctcctcctcctcctcctccttcatcctctctgtcaggacagcagaccgagcaacagaacaaagaatctgagaaaaagcaaactaagccaaacaaggtgaaaaaaatcaaagaggaggaattagaggccaccaaacccgaaaaacaccccaaaaaagaggaaaaaatctcatctgctctttcagtgttgggcaaagttgtaggtgaaacacatgtcgatcctattcagttgcaggcattacagaatgcaattgctggtgacccagcttcctttataggcggacagttcttgccatactttatccctgggtttgcttcttattttacacctcagctccctggaacagtgcaggggggatacttcccacctgtctgtggcatggagagcctctttccttatggccctacaatgccccagacactggcaggtctgtccccaggtgcactgttgcagcagtaccaacagtatcagcagaacctgcaggagtccctgcaaaagcagcaaaagcaacagcaagaacagcagcagaaaccagttcaggcaaagacatccaaagtagaaagtgaccagccgcaaaactccaacgatgcttcagaaacaaaggaagacaaaagtactgctacagaaagcacaaaagaagaaccccagttagaatccaaaagtgcagacttttcagacacttacgttgttccattcgtcaagtatgagtttatatgcagaaagtgccagatgatgtttactgatgaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacacctccagtcaagcttgcacaaagagaaaacaatcaaacaagcaatgagaaatgccaaagagcatgttagattattacctcactcagtctgctcccctaatcctaacaccacatctacctcgcagtctgcagcttcttctaataacacctatcctcatctttcttgcttctccatgaagtcctggcctaatatccttttccaagcgtctgccaggagagctgcttctcccccttcttctcctccttccctttccttgccttcaacggttacctcaagtttgtgcagcacctcaggggttcaaacctcactacccacagaaagttgttcagatgagtctgacagtgagctgagccagaagctagaagacttagataattctttggaagtgaaggctaagcctgcttctggcctagatggtaatttcaatagcatccgaatggatatgttcagtgtgtaggagtgaagacaggatcccgtgcttaaaaaaataaaaaataaaaaaataaaaaaaaaataagactttaactgcagttccaaagcttctctaacccaaaaattacagtaccaaatgattgactcaggattgtttttcccatattgatatgctggcaatataggatggtatgtaatggacagaactgatgcagatggttgaatgcgcttgtactatatgctaaaatatggaaaaggaaaaaaaaatctcacaagttcttttggaacttgtttcaagccaaaaactctcaagaaagcaaattgcacctcagctggattgatttccaaatgctagcatgtactgtatgggaggatgatccagatgtttcaaagagaatttctcttagtttagttaggtgtaattcagtagctttaaattctcaggtcagaacataacatttctcatttgttaaaagcagcaagaagcctggtaaaactgtgacttttccccaaacgtcaatctttattagaaagcattttctaggtgtgtttagtgtacaaagagactttataacccttactggacaacacacagatccttgagctcacgctgcaggatagtacagttttaccgcagagggaatctggaacagtggaatcatgtgtctgccctgtgtattgcagtttgtattgccacaagctatatttataccagtgtcacccttttcttgtagaatatactaataatctgtgccaactctaccttctcacttttacctctgacgtcattctttttttctgaaagaggtaataattctagttttgatagactctgaggattatgtgaacaggacatttttcatttgtgaatttaatgctatactgtcaaggtacttgcttgtgtctgaactctagtgcacttatgattttgtagaccatgtgaaatttaataagataccttttttttcctttctttgtgtgtagtgcagcaacagtttggtctgcatttgttagaagtttaactcctaacaacccaaagacctatttaacaattggtgcataaatgaaagtagtactgtatacttgaaactgtttaagtacaagttgaacaaaaattatgaaaaggtatatttgcttctcgggaaagcaaagaagctgctttaaaaaataaaaaggggactaaaaatttgttttgtataaagaggttagccctgcgcacgtaggactgaattcagtgatatccctatacactgccatttagtggataggttattgtacttccattcatactctgggcacttgtgttgtattgttctgttacatactttttttaacctgttttgttttatcatatatgcattaaaagtattatctttatcaacatttgctgctactgtgttaacatttttgttttgcttgccatgaatttcaacttccaccacccagtgaattgatttataaattgctatgctttgctgtttttctgttgctgtggaacttaaagaatgtgaaagctgtcaaagggtattttacgaatcacttttgtgtttgatatagtaaaacaatgtgattcattccaaagtaacagaaggttatttgtaagaaagttaaaggcttgtgaacaaagaaagctaagctgttgtacatatttgtagttggctgtgcatggtacaaatttattaatatgaagaaatgcaaaatgtattgcttttgatatttctcttccgagatgaacaagtagcatgtaatgcaactgtttgacagtttaactcaagtcatgcttcaaactgttttaatgatcaaatcaagacacatttcattttacattttattattgtacagtttttgtttcggatgatgatcacagcaatctttattctatacattttatgtgaacttttttaatgtctttaatttggattttttttttttttagtattttaacatttattttaatcctgaagacacttttttgattgtgtttcgtaagagacaacatggcctcctaaggtgcaatcctgccgctatagtgagctaatgtcctgaatccaaaggcttcagaaaattgcttttgcctttttcatgaatgttaagcagcagcattgtgagatcgatctgtcctggcagttaacacgatgtgcaacagtgtgttagcatggaacagaacgcttttcacaaaacaaaggactgttttacaaatgattattccgacagtgtgtcgacataaacttttacaactgcacagcagccaaaaaaagaaaaaaaaaagaaaaaaaactttaactggatggacgttgttagggtgagaaataaaaggacagcctccaaaggttgagaatgagaattgttttttcctggatatcaaagggattatcacagcgcaatcattgtctacacaacatgtactctcaacgcctgggttacataggaaatgcaccctgaggttttaataaaagcccctatggctataactttaaataaactaaaccaaaaatgttattgatgttttatatatagagagtagtctcattagtttttgttactgtaatgtttgaagtctcaaatgcaccgtattacggtaaataacatggttttgaaaacttttttttattttgtcacagacctgttgtcatagttgaaatgatgtttattgtagatggtatttgaacttattcttctggaaatagttcatcaagtatgtttgttgctcattgtgatacattaaaaactgtatctacatattta

SEQ ID NO: 34789 - DNA, 561 bp, Homo sapiens
acggaaaccaaagctcatggaaattcctgggaaacatcacataactacagagtgcagctgaagaaattgagtgttcactgcctgataaagaaaaggtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatat

SEQ ID NO: 34790 - DNA, 524 bp, Homo sapiens
gtagtattatatttttagttgggtggatggatggaagagtgagagagaggctgcggctgccgctgccttttcgggtgttgcttagattaaggctgagacttggctgcgattgggacgcgacagtgacacgggcatcgatcgcttccattgagagcaatgcaaaaacacagcccgggtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccct

SEQ ID NO: 34791 - DNA, 2409 bp, Homo sapiens
tctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagaagagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtgaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcgagagctggagagcttggtcccaaggctaggtgtgaagttagccaaaaccccaatgcggacatggggtccccggccaggcttcacctttgcttcccttcgtgctcgaacctgccatgtgtgtcacaggcacagctttgaagcgaagctgacaccttgcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctgccttttacctacaccgcagaggtgaccagtgaaaccttcaacaaagaggccttcctggcctctcggggcctcactcgtggctattggacccagctcagcatgctgattccaggcccgggcttctccagacacccccgaggcaacacgccatccctcagccttcttcgcggtggagacccctaccagcttctccagggagacgggactgccctgatgcctcctgtgcccccacatccaccccggggtgtttttggctcatggcaggattactacacatggcggggcctcagcttggactcccccatagccgtgcttctcacctacccgctgaccgtgtactacgtcatcacccacctggtgccccagtccttccctgagctcaacatccaaaacaaacagtcactgaagatccacgtggtggaggccgggaaggagtttgaccttgtcatggtgttttgggagcttttggtcctgctcccccatgtggccctggagctgcagtttgtaggtgatggcctgccccccgaaagcgacgagcagcattttaccctgcagagggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattgcttctccctcctctctgtctgcaggatttaactccgggtttgctctcaaggatacgtggctgaggtctctgccccggttacagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaacca

SEQ ID NO: 34792 - DNA, 2274 bp, Homo sapiens
cggctgcagtctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagaagagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtgaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcgagagctggagagcttggtcccaaggctaggtgtgaagttagccaaaaccccaatgcggacatggggtccccggccaggcttcacctttgcttcccttcgtgctcgaacctgccatgtgtgtcacaggcacagctttgaagcgaagctgacaccttgcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctgccttttacctacaccgcagaggtgaccagtgaaaccttcaacaaagaggccttcctggcctctcggggcctcactcgtggctattggacccagctcagcatgctgattccaggcccgggcttctccagacacccccgaggcaacacgccatccctcagccttcttcgcggtggagacccctaccagcttctccagggagacgggactgccctgatgcctcctgtgcccccacatccaccccggggtgtttttgtccctgagctcaacatccaaaacaaacagtcactgaagatccacgtggtggaggccgggaaggagtttgaccttgtcatggtgttttgggagcttttggtcctgctcccccatgtggccctggagctgcagtttgtaggtgatggcctgccccccgaaagcgacgagcagcattttaccctgcagagggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattggatttaactccgggtttgctctcaaggatacgtggctgaggtctctgccccggttacagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaa

SEQ ID NO: 34793 - DNA, 4441 bp, Homo sapiens
acggggaggtggcgccgccgtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcaagtggcattcacccaaaagaaagtacttactcaggagagagtctctgaaagtggtaaatatgggggaaactgtcttcttcctgctcagctagtactgagagagtatttccataaacgtgactcacatactaaaagtttaaaacatgatttagttcttaatggtcatcaggacagttgtgcaagtaacagtaatgaatgtggtcaaactttctgtcaaaacattcaccttattcagtttgcaagaactcacacaggtgataaatcctacaaatgccctgataatgacaactctcttactcatggttcatctcttggtatatcaaagggcatacatagagagaaaccctatgaatgtaaggaatgtggaaaattcttcagctggcgctctaatcttactaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaataaatatgggaatttttcacaaagagcaatgactttattttgcattggagaactcctggagataagctgtacaaattgaatctatgtggaaatgctttcagtcttgttactatcctattgcacattagagaattggtcctggaagggaaagaaaccacagattttatttcagtacacaaatccatcagattttcttcttttcatgaattcctacagaagtaattggcctgagagcattcttgaccaagtcttaaatgctagaatctgagaaggaattattaaataggtgagttgttgagcgagaaccccttcatttgaaaagaaatgagtatgctactatagggagagttgttgctgagaattaagaaatgatacagttaatgcaacaaaagatggaaaataatatttcagtcaatatgtcattgttttcttgactatgtctctcttctgggacatttagtagtgtttggtatgttttatgtgtctggtagaaaccatattttggttaacagcaagaaaaatgcttataatgtagtacaattaaaaacaacacatctccactaccagtgctaacccatttttaagtacatttgcatgtgggcaagaattgaaagtatacagataattgaacagaattgatttgttagataaggagattttgactgagttttatagtctgtttaatgttgctgtaataattattttaagaaacttttaaatattgtaagaggatatctagtttctctattctaccatcaaagaagcttttgagtaccacctgttaatgagctttcctattctaaattgttttgggtcacagagttccactttttccactcttattagcactgcaaaagctcctgagaatttaaaaacacagtaattctctggatgttaggacctaggggaacattgggcatttgaacatatcagggagggtccccattttagtgggaacaagtatttaaacaatatttagagcaagtgtcctcatgtgataaacagagcacagtccaaagataccctctttctcaaggtagtcttttatctttataaagaaagattagtgtttaagagcgtagacttgagctagactacccaggttgaaaccccactagctgggtgatcttgaacatgctgcttagcttctctgtgccaaacttactgatatcctcatctgtaaattagcgataataatagtacttacctggtaggattatggtgagtattaaatgagtaaatggaaacagcttagaatagtgcctgacatatattatgttctctgtagttactggctgtgattattaataatattgccgcaccctaatatctgttatttaattgaaatctgcttgtgtgcttataagaatttactgagttctcacttcccttacagtcatacatggtttttcccttttgcctaaatcagaactcaacagcctgggaaaatcactgacaaatagtggatataggtttcatttctgaggatcaataaacagcttgtaatgttgtatacacatttattctgtttgtacaaaggttttccattctatggagaggatcccagtcttcagattctctggtaagttaataacccacaaaagattcaggaagaggatctattttaattttctctttcattctataaatcagtctgttgtatatagggactgaccatgattctccattttctggcataaatattagctgctcaatgattgattgttgaatgatagatgaagtattgctgaagccaaccagagatcttgatctctctctgaggaaaaaacctagaaatgatggttagaatcaggagacttgagaactacgaggaacatggcagcctctagctcatacttgtcgttgtacaattgagatcaagtgaattggccccggtctcacattttcagtgaagtcagactcagaactaggtcctgggtttcatgtttcctgctgctcttctcactgtgtacacaccatgcccacatacaacatacctatcagaaatggttttcattaagggagtagaatagtcacttaactggggctcttaacattgctaataacctgtggctcaatttcctcaactgtataatgaggttactactagtatctacctcaaagcgttgtcatgtggattgagatgatatgtatgaatcacataaaagagtgcctggcacatagtaggtgccattaataatattactattgttaacaccttaagggtctaacttgtaatgaagacagaaatatgtatgaggatgatcactgaaatatttatgacagtgcataatttgcaaaataaaaaatgtacactagcataatatttgtggcatatccgtgtaatggaagattatgcaggcattaaaatatgtacacaaaaagtttggtaaaggaaaaatgctgtcatgtgttacaaaagcatgataaataattgttaatatggaataagctcaaatatgtcaaaataaatgtaaaaaatgagtgttgcccaaaa

SEQ ID NO: 34794 - DNA, 2169 bp, Homo sapiens
agactcacctctgacgccgctcttcgcgctccgctggtgaatggagtcgcgttctctgttttgctgttgctgctgcctttgtgacgggatcgctttctcccatcgaaccttctagttgcttattgcaggtatatacgaaagtgctgaattttgtgtttgcatcgtcatcaggcgcgtgttgagccctttagtaatgtagcagtgtattagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtgctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcaagtggcattcacccaaaagaaagtacttactcaggagagagtctctgaaagtggtaaatatgggggaaactgtcttcttcctgctcagctagtactgagagagtatttccataaacgtgactcacatactaaaagtttaaaacatgatttagttcttaatggtcatcaggacagttgtgcaagtaacagtaatgaatgtggtcaaactttctgtcaaaacattcaccttattcagtttgcaagaactcacacaggtgataaatcctacaaatgccctgataatgacaactctcttactcatggttcatctcttggtatatcaaagggcatacatagagagaaaccctatgaatgtaaggaatgtggaaaattcttcagctggcgctctaatcttactaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaa

SEQ ID NO: 34795 - DNA, 472 bp, Homo sapiens
gtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagtggctgtgggagcaaagagtaagaaacactaaaacttcctggagaaattagctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctg

SEQ ID NO: 34796 - DNA, 546 bp, Homo sapiens
gtgcgtgacgtcaggccacggggaggtggcgccgccgtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtgctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatg

SEQ ID NO: 34797 - DNA, 648 bp, Homo sapiens
ggccacggggaggtggcgccgccgtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtggaaacattaaagaatgtgcttcagagagaaaggaaatgaaaccaaatggaaatctggatctacacaaacgagtaaacagcactggcgaatggtaactacctagctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactat

SEQ ID NO: 34798 - DNA, 5645 bp, Homo sapiens
gtgtcttctgctcctaggggcctagcctgtgtggccctctgacctgcagatattgggagatccacagctaagacgccaggaccccctagaagcctagaaatggatgacccgaggtatggaatgtgtcctctcaagggagcaagtggatgccctggggctgagaggagtcttctggtgcagtcttattttgaaaaggggccattgacgtttagggatgtggccatagaattctctctggaggagtggcaatgcctggacagtgctcagcagggtttgtataggaaagtgatgttagagaactacagaaacctggtcttcttggcaggtattgctctcactaagccagacctgatcacctgtctggagcaaggaaaagagccctggaatataaagagacatgagatggtagccaaacccccagttatatgttctcattttccccaagacctttgggcagagcaggacattaaagattcttttcaagaagcgattctgaaaaaatatggaaaatatggacatgacaatttacagttacaaaaaggctgtaaaagtgtggatgagtgtaaagtgcacaaagaacatgataacaaattaaaccagtgtttgataactacccagagcaacatatttcaatgtgatccatctgcaaaagtctttcatacattttcaaattcaaacagacataagataagacatactagaaagaaacctttcaaatgtaaaaaatgtgaaaaatcattttgcatgcttttacacctaactcaacataaaagatttcatattacagagaattcctaccaatgtaaagattgtggcaaagccttcaactggttctcaacccttactacacacaggagaattcatactggagagaaaccctacaaatgtgaagaatgtgggaaagcatttaaccggtcctcacaccttactacacataagataattcatactggagagaaaccatacagatgtgaagaatgtgggaaagcttttaaccggtcttcacaccttactacacataaaagaattcatactggagtgaaaccctacaaatgtacagaatgtggcaaagcttttaaccggtcctcacaccttactacacacaggataattcatactggagagaaaccctacaaatgtgaagaatgtggcaaagcctttaaccagtcctcaacccttactacacataagataactcatgctggagagaaaccttacaaatgtgaagaatgtggcaaagctttttaccgattctcataccttactaaacataagacaagtcatactggagagaaattctacaaatgtgaagaatgcggcaaaggctttaactggtcctcagccctcactaaacataagagaattcatactggagagaaaccctacaaatgtgaagaatgtggcaaagcttttaatgagtcctcaaaccttactacccataagatgattcatactggagagaaaccctacaaatgtgacgaatgtggcaaagcctttaaccggtcctcacaactaactgcacataagatgattcatactggagagaaaccctacaaatgtgaggaatgtggcaaagcttttaaccgatcctcaacccttactaaacataagataactcatactggagagaaatcttacaaatgggaagaatgtggtaaagactttaaccagtccctaagccttattaaacaaaataactcatactggagagaaaccctacaaatgtgaaaaatgtggcaaagccttttaccagtcctcaactcttactaaacataaaaaaattcatactggagggaactcctgtgactgtgaagaatatggcaaagcctttaataaattctcaattcctaacagacataagataattcatactagagagaaattctacaaaccagaaagatgtgacagtgctttgaaaacacctcaaacttttcaaaacataaatcatagtgttgagaaatcctagaaatgtgaagaatgtgataaagttttaaatggttgtcacacttgattgtaggtaaggtaagttatactggagaaaacttctacatgtgtgaacagtgtgacaaaacttttaactaatgctcacaccttcacaggaaagcatttatacttgagaaatattgtacaaatataaagactgtgaaaaagccattaatacatgctcacatcttactcaacatcagagagttcatactcaataaaaacataagtgcaactactgtcaaaatatctttaagaaaatataagcttttaaagtgaagagtattttgaagaagaacattgtagtagaattgtaatatgtttacttgtatcacagatcttactgtacacgttttgtattagaggaaacctctgaagcagttgctcaaactttgttcaatatcagggaatttatattgaaaaaaactgtgcgaatgtaataaagttggaaaaatactttttcaaaaactacagcttagaaaacaccagagagttcatactaaaacatatttttgcagatacaggaaaaattttttaaaaattttaatcattaagtctgtaaatatcagagaatttacagtagaaatatgtaaggcactgatgcttcaggtattttactaaatcagagtgctgagtatagaaaataatctaaaactaaaattggtaaaatatttgtatataactttaaaagtagaaattttttgcagttattgcattcaaagtatgcttaactttttgaaaaaattagattttttgaaaagtgagtaataatgtaattcaactcttaaattatttcctgccttttcttcactcctatttacatgtgaaagcatgtgatcaattgttgctgcatcagatatgagagattcttttttattaggtgagcattatttataaactttgctatgaaaaagacattaaaatatgagatgtatgatgaaaatctaagtgaagagacttttatggttaacttataatattaagcaatgtgtgcgttaggcattcagagtaatattctgcattatgagaaaacttaatttcatttataagtaaattaaaattagtatattttactaatacttttatataaaatgcagtatattttttaaatttcagattatatgtgatgttaatatattcaacctttttaacatgttaaatactattgtgcattcagtgaagtgttattatgccacagacattaacctattccaccttactcaagggtgtacgtaaaacatggtaacagtatactatttggtaacataatggattaacatctctagtaatctcttttgctagtggctttgactgcaaataagttaaagaatattatttctgtaggttaaatttttgtttttattttattttatttttgagaggtagtcttgctctgtcacccaggctggagtgcagtggcacgatctcggctcactgtaacctccacctcctgggttcacgcaattctcctgcctcagcctcctaagtagctgggattacaggcacccaccaccatgcccagctaatttttgtattttagtagagacagggtttcataatgtaagtcaagctggtctcgaactcctgaccttaaatgatttgcctgcctcggcttcccaaagttctgggattacaggcatgagccaccgtgcccagccaaatgtttattttatttaaatttatttttcttaattatttggggtacataatatgagtatatattcatgcaatatatggcatattttgatacaagaatacagtatataataatcacatcagggtaaatgaggtatccatcacctctagtatttatcctttgtattacaagcaacccagttttatacttttagttattttaaaatgtaaaattaaattgttattgattacagtgttatttttatggtcataataaaagttatgtagaagtataataaaatccctacatttctgaggcctgaataagtatttttaaagttttctaatatttattttttgagcatgtttcctgtctgcctgcaaacacatgcagacatttagttttgatttacatatagttaaatatatgttagtctaaagataaaccttaagtgtaagaaaattatagagtgagtttgtgtgtatgaatttgtacctgttttccgaagaaaaaagcaatactgaacaaaacaaatcattttaacaagatgactactagaaaactaaaagcctcaaaaatgctaaaagaaaatgtattctctgctttgtattgaatttattactgtacattctgtggcttatagttctgaatctccccatgaaaattctgtttatacttgcctggtactcatgatagacccctaattattttgtatcttttttcatataaatattttacagattatgaagtattcattatgtgagctggtctgtgattataagaataatttttacaaaatttagtgcatacaaaatttttaaatgtaattccacaattagtgtattaagttacattttatttagttagaacacttcattttgtttttagttggagaactctatagccctttagttatttttcttttcactttttatagttgacataagtaaatttatttattgagtcaatttgttcaggtaagtactagggaagctttataagtcgtgaggatgtttttatatttaaatgtagcaaacatacatgacagttcttgctgtgtaacagatgctccatagtaagccataagtattcctgctaaagttagcttgtaacttcagttcagagatggaaaacatcagtggtgaagaaataaaattgattcttcatgtggagaggacatagtttccaggctgcaatgctgaatcttgctgaatttaaagagaagttctgcatcttttatttcttaattatcttcagatttctctgtatttattatgtgtatccccagctatgtatgcagcacagcccatctcctttttctgtgttatggcttcagttttctcactgttgtcttaatgccatttcatttcacatggtactttgtaaattttgacgagaaagttggttgtttttttttttttttttttttttgagacagagtctcactcttgttgcccaagctggagtgcagtggtgcaatgtgggctcactgcaacctctgccttccaggttcaagcaattatcctgcctcagcctcccaagtagctgggattacaggcacctgccaccacatctggctgaatttttttttttttaattttttgtagagacgaagtttcaccatgttggccaggctggtttcaaactcctgacctcatatgatccacctgcctcagcctcccaaagtgcttggattacaggcataagccactgcacccagctgaaagttggtattttttaatgcactgaataattgtttttaactggagagtttggttatcaatataactttcggattagttaagataaaagcatacattgtccacaggtgagaagattaaatcagaatagttgttctttgttaaaaaaaaaattagattcttaaagtgtggcaaacataaaatttgcaagaaaatgtagaaattaaatttttaagagttaatggtaagtgaacaattttaaatttattttttattatgtaacatacttttattaaaatatatacttatataataaaagtataaca

SEQ ID NO: 34799 - DNA, 1830 bp, Homo sapiens
aacttccaaagcccgaagcggtctcatttcccgccggccccccattcgggtccgggttttagttcctcggggagcccctggtgccccggatacggctgattttgtcgtgtgggacctgttctggctgctccagccccaggaaggacccaggacacccggaagccggaaatggactcagtggcctttgaggatgtggctgtgaacttcacccaggaggagtgggctttgctgagtccttcccagaagaatctctacagagatgtgacgctggaaaccttcaggaacctggcctcggtcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggccccatatcggctgggtacggtggctcacgcttgtaatcccagcactttgggaggctgaggcgggtggatcacctgaggtcaggagttcaagactagcctggccaacatggtgaaaccccgtctctactaaaaatacaaaaaaattaactgggcatggtggtgggcacctgtaatctcagctactcgggaggccgaggcaggagaatcgcttgaacctgggaggtggaggttgcagtgagccgagatcgcgccgctgcactccagcctggtgacagagcgagacttcgtctcaaaacaaacaaaaaaaagaaggccccatatctcc

SEQ ID NO: 34800 - DNA, 1450 bp, Homo sapiens
ttagttcctcggggagcccctggtgccccggatacggctgattttgtcgtgtgggacctgttctggctgctccagccccaggaaggacccaggacacccggaagccggaaatggactcagtggcctttgaggatgtggctgtgaacttcacccaggaggagtgggctttgctgagtccttcccagaagaatctctacagagatgtgacgctggaaaccttcaggaacctggcctcggtcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggcccc

SEQ ID NO: 34801 - DNA, 1552 bp, Homo sapiens
cgtgtgggacctgttctggctgctccagccccaggaaggacccaggacacccggaagccggaaatgacaaagtcttgccctgttgcccaggctggagtgcaatggtacaatcttggctcactacaacctccgctaaagtgattctcctgcctcagccctcccccacgcccggtagctgaacccggtagctgaatcctgagtagctgggattacaggactcagtggcctttgaggatgtggctgtgaacttcacccaggaggagtgggctttgctgagtccttcccagaagaatctctacagagatgtgacgctggaaaccttcaggaacctggcctcggtcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggcccc

SEQ ID NO: 34802 - DNA, 4627 bp, Homo sapiens
ttagttcctcggggagcccctggtgccccggatacggctgattttgtcgtgtgggacctgttctggctgctccagccccaggaaggacccaggacacccggaagccggaaatggactcagtggcctttgaggatgtggctgtgaacttcacccaggaggagtgggctttgctgagtccttcccagaagaatctctacagagatgtgacgctggaaaccttcaggaacctggcctcggtcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggccccatatcggctgggtacggtggctcacgcttgtaatcccagcactttgggaggctgaggcgggtggatcacctgaggtcaggagttcaagactagcctggccaacatggtgaaaccccgtctctactaaaaatacaaaaaaattaactgggcatggtggtgggcacctgtaatctcagctactcgggaggccgaggcaggagaatcgcttgaacctgggaggtggaggttgcagtgagccgagatcacgccattgcactccagcctgggcgacaaaagtgagactccatcacacacacacacaaaaaagccccatatcacgtggtggctcatgcctgtaaaaccagcactttgggaagccgaggtgggtggatcacgaggtccagagatggagactatcttggccaacatggtgaaaccccgtctctactaaaaatacaaaaattagccaggcgtggtggtgtgtgcctgtagtcccagctactcgggaggctgaggcaggagaattgcttgaaccagggacttggaggttgcagtgagccgagatcgcgccgctgcactccagcctggtgacagagcgagacttcgtctcaaaacaaacaaaaaaaagaaggccccatatctccaaagaaaaaaaaaattaactgggtgaggtggtgcatccctgtagttctagctgctcagaaagctgaggtgggaggaacccttgagcctgggaggttgaggctgcagtgagctgagatcgtgccactacactccagcctggatgacggtgacactctgtctcagaaaaaaagggaaagaaataattctcatttatacaggagagaaatcctatgaatgtaaggaatatgggaatacattcagtttccaaagatatgaaaagactaactggaaaaaaatccaaagacctcagatattccagttctattcagagccataaaaggactcatactggagaaaaattgtagaaatgtacagaatatggggaaactctcattgctctcatctccattcaaagacacgtgtcagtgcacactggagatggatggtatgaatcgaagaatacacactggatggaaacgttagtagtttggaaaatacaggaaacttccattttaacaataattaaaattcacatgggctgtgcacagtggctctcccctgtaatcccagcattttgggaggctggggtgggtagattgcttgaggccaggtattcaagaccagcctggcaacctggagaaatcccatgtatacaaaaaatagaaaagttagccagggatgatggtgttcgcctgtagtcccagctactcaggaagctgaggtgggaggattgcttgagtttgggaggtcgaggttgcagtgagtggagattgcgccactggactccagcctgggcaacagtgagaccctgtctaaaaaaattaatcatgtgagaacatccactcgaaagaaatcctataaacgtaagtaattttgaaagcctgatgcaaattaattattatataatgctcaaaaacttaatcatgaatgagttattacacaaagttataaatatatagcatttatcagtggctcattcttttttctttcttttttttttttttttttgagatggagttttgccctgtcgcccaggctggagtgcagtggcacaatctcggctcactgcaacctccgcctcctgggtgtgagcaattttcctgcctcagcctcctgagtaactgggattataagcacatgccaccacgcctggctaatttttttgtatttttagtagagacggggcttcaccatgtggttcaggctggtctcagactcctgaccttgtgatccgccctccttggcctcccaaagtgctgagattacaggtgtgagccaccgcgcctggccttttttttttttcccgagacacagtctcactctgttgcccaggctagagtgcagtggcgcgatcttgactcactgtaacctctgacttctgggttcaagcaattctcctgcttcagtctccgaagcatctgggattacaggcgcacgccaccatgcccagctaaatttttggtatttttgtagaaacagggtttttccacattggccaggctggtcttgaactcctgacctcaaggaatccatcctcttcagcctcgcaaagtgctgagattataggcatgagacaccttgcccggcccctgtgactcattcttaaaaaggatctttggattatgggtttccacttttgcaaggaaatgtgagaatgatactctttaagcagtggtacctgaggtttaataggaagtgtttttatcctaagttagttaataaaatttttttctatccattttggttttcatttttttctatccattttaaagtgttggatctgtgggtgaagtgaaatttatttctaatatgtaagcaggtttaatttttatgtagtgtttaattgttctgtgatgaatgggccattacaaaatgagtctatttttgtttgttttcttttgtttttgagactgagtcttgctctgtcgccaggctgaagtgtagtggcgcgatcttggctcactgcaacctccacctcccgggttcaagtaatccccctgccttagcctcctacaggcgcgtgccgacatgcctggctaattttttgtattttagtagagacggggtttcattgtactggccaggatggtcttgatttcctgaccttgtgatccaccccaccttggcctcccaaagtgctgagattacaggagtgagccactgcgaccggcccatgagtctttattaatagagatttcttactggtgttatgtggcagattctgcatattcctcacccatcatatgtattccactttcctttattatggggaaaactactctttttggcatgatacaatgttgactccattttctttgctaataaggacttggtatcaatttatcagtatgtaaagtttaccatagagtattgtctcatgtgaatcattcccattttttgctctttactctttgtcgttatttctgagtattatttggatggttcattttgacttaaggatagccctgtgatatgacaatatttttatctaatctgatggagaaagcatttagtctcctgatcaagtatgatgttagctgcaggtttttaataaatgccttaattcagtttgaa

SEQ ID NO: 34803 - DNA, 5174 bp, Homo sapiens
tagaggcccagcctctgtgtccctgtgacctgcagatattgggagatccacagctaagacgccgggactccctggaaacctagaaatgactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggataggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagcctttaactggttctcaactcttactaaacataagagaattcatactggagaaaagccctacaaatgtgaagaatgtggcaaagcctttaaccagtcctcacaacttactaggcataagataattcatactgaagagaaacccaacaaatgtgaagaatgtggcaaggcctttaaacaggcctcacaccttactatacataaaataattcatactggagaaaaaccttacaaatatgaagaatgtggcaaagtctttagccagtcctcacaccttactacacaaaagatacttcacactggagagaacctctacaagtgtaaagaatgtggaaaagcttttaacctattctcaaatcttactaaccataagagaattcatgctggggagaaaccctacaaatgtaaagaatgtggcagagcttttaacatatcctcaaaccttaataaacaggagaaaattcatactggagggaaactcaacaaatgtgaagaatgtgacaaagcttttaaccgatccttaaaacttactgcacataagaaaattctaatggaagagaaaccctacaaatgtgaagaatgtggcaaagtctttaaccagttctcaactcttactagacataagataattcatactggagagaaaccctacaaatgtaaagaatgtggcaaagcttttaaccaatcttcaaaccttactgaacataagaaaattcatactgcagagaaatcctataaatgtgaagaatgtggcaaagcttttaaccaacactcaaacctaattaaccataggaaaatttattctggagagaaaccatacaaatgtgaagaatgtggaaaagcttttaatcgatcctcaacccttactagacataagaaaattcatactggagagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttactacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgagtatggcaaaacttaattgatcctacaagcttactacacataggaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatactttaaaccaatcctcaaacctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgtttaaaaa

SEQ ID NO: 34804 - DNA, 1061 bp, Homo sapiens
gcctttgtctctggctgcagccggagctcctgctctcctcctcactgctcagtgtcctctgctcctagaggcccagcctctgtgtccctgtgacctgcagatattgggagatccacagctaagacgccgggactccctggaaacctagaaatgatggagtctcgctctgttgctcaggctgaagggcagtggtgcgatctcggctcactgaaacctccgccttccgggctcaagcaattctcctgcctcaacctcgcaagtagctgggattacaggcatgcaccaccatgcccagactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggataggtctggccccaccctggagtcttgcctcacagaactgattagaagagatcagagttttggctggtgcctttccggagtggttgctaacaattcccgaattccacaaggagataaatgggaaaaaaaggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaa

SEQ ID NO: 34805 - DNA, 6094 bp, Homo sapiens
catcttaaagcttccctttgagagtgttgctcttagaacttttcagatcttgttcagtgacctgctacagttatgtgagaggatccaggtgtaaatagaatctgatgacagattctgtaagcgtaaacaagcatcttaggggtgagagatgaaggccacaaagtatcgagagtcatgatcacaattatacctacccgtaaaatgtaatactggactagagtattttttctttccttttgcccaagagctagctaattaggacccgtaatctggagctccactgtggcagttccactttctatttagaatcagcctgagtctctcctgcctgccttatccttggccatcagcccagggtcactgggaactctctcacaatcacctaggcatctttgagatatttgaggatgtccagagcagaattgtgtcaggttgacaagagtggttaattctgcctctgtctcagtgtaagagaaatgagacatcctgtgtttgctcctcccctcatacaagagatgtctttggttggtatccagttgagagtttcccagtttcctgatagttggatgaaaaacaaggaggaggtctggagactcaagcagataaactaattgctaccatttcatatggcccttagaaaaatagataaagcagtcatggtccctaccatctaggaactgttagtctagactagcaactgaatacgtggttgaattaagcatcatatggttggcaaagtgaatagatgtgtgggaaaacgtgtgggctttatttgggccactttctttatatcgttgtgacttctgaggtcatcatttgaatgaatgtttatgaccacaagagttttaaatatttttatttcttttactttgctaagaatacatatttatcttataataaaattaccctagaaaaccccaggagatttgtttaaatggctaattagtatatttacacagttgatgggttgagcagagtaatatatagggtttactcccagctgcagttctgttcagattcaccctttttggaggctttatttaggtctggccccaccctggagtcttgcctcacagaactgattagaagagatcagagttttggctggtgcctttccggagtggttgctaacaattcccgaattccacaaggagataaatgggaaaaaaaggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagcctttaactggttctcaactcttactaaacataagagaattcatactggagaaaagccctacaaatgtgaagaatgtggcaaagcctttaaccagtcctcacaacttactaggcataagataattcatactgaagagaaacccaacaaatgtgaagaatgtggcaaggcctttaaacaggcctcacaccttactatacataaaataattcatactggagaaaaaccttacaaatatgaagaatgtggcaaagtctttagccagtcctcacaccttactacacaaaagatacttcacactggagagaacctctacaagtgtaaagaatgtggaaaagcttttaacctattctcaaatcttactaaccataagagaattcatgctggggagaaaccctacaaatgtaaagaatgtggcagagcttttaacatatcctcaaaccttaataaacaggagaaaattcatactggagggaaactcaacaaatgtgaagaatgtgacaaagcttttaaccgatccttaaaacttactgcacataagaaaattctaatggaagagaaaccctacaaatgtgaagaatgtggcaaagtctttaaccagttctcaactcttactagacataagataattcatactggagagaaaccctacaaatgtaaagaatgtggcaaagcttttaaccaatcttcaaaccttactgaacataagaaaattcatactgcagagaaatcctataaatgtgaagaatgtggcaaagcttttaaccaacactcaaacctaattaaccataggaaaatttattctggagagaaaccatacaaatgtgaagaatgtggaaaagcttttaatcgatcctcaacccttactagacataagaaaattcatactggagagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttactacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgagtatggcaaaacttaattgatcctacaagcttactacacataggaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatactttaaaccaatcctcaaacctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgtttaa

SEQ ID NO: 34806 - DNA, 5212 bp, Homo sapiens
ccagactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggataggtctggccccaccctggagtcttgcctcacagaactgattagaagagatcagagttttggctggtgcctttccggagtggttgctaacaattcccgaattccacaaggagataaatgggaaaaaaaggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagcctttaactggttctcaactcttactaaacataagagaattcatactggagaaaagccctacaaatgtgaagaatgtggcaaagcctttaaccagtcctcacaacttactaggcataagataattcatactgaagagaaacccaacaaatgtgaagaatgtggcaaggcctttaaacaggcctcacaccttactatacataaaataattcatactggagaaaaaccttacaaatatgaagaatgtggcaaagtctttagccagtcctcacaccttactacacaaaagatacttcacactggagagaacctctacaagtgtaaagaatgtggaaaagcttttaacctattctcaaatcttactaaccataagagaattcatgctggggagaaaccctacaaatgtaaagaatgtggcagagcttttaacatatcctcaaaccttaataaacaggagaaaattcatactggagggaaactcaacaaatgtgaagaatgtgacaaagcttttaaccgatccttaaaacttactgcacataagaaaattctaatggaagagaaaccctacaaatgtgaagaatgtggcaaagtctttaaccagttctcaactcttactagacataagataattcatactggagagaaaccctacaaatgtaaagaatgtggcaaagcttttaaccaatcttcaaaccttactgaacataagaaaattcatactgcagagaaatcctataaatgtgaagaatgtggcaaagcttttaaccaacactcaaacctaattaaccataggaaaatttattctggagagaaaccatacaaatgtgaagaatgtggaaaagcttttaatcgatcctcaacccttactagacataagaaaattcatactggagagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttactacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgagtatggcaaaacttaattgatcctacaagcttactacacataggaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatactttaaaccaatcctcaaacctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgttt

SEQ ID NO: 34807 - DNA, 1667 bp, Homo sapiens
atttggcggggcctttgtctctggctgcagccggagctcctgctctcctcctcactgctcagtgtcctctgctcctagaggcccagcctctgtgtccctgtgacctgcagatattgggagatccacagctaagacgccgggactccctggaaacctagaaatgactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggataggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatat

SEQ ID NO: 34808 - DNA, 2206 bp, Homo sapiens
acagcgaggacccaaggctggggtttcctgcttggatcaggagtgcctggggatttgatccccatcctggtgcagctccgagacgctcctgggctgcgcgcgcttttgggctgcgccaccgacagagacatctggaagccggagctagtggaagactctgcctcacctgcctccttgaaggaaacacggggaagccaggactggccgtcacgttggtgacaaatatgtcccaggactcggtgaccttcgcagacgtggctgtgaacttcaccaaagaggagtggaccctgctggacccagctcagaggaatctctacagagacgtgatgctggaaaattctaggaacttggcattcatagattgggcaactccatgtaaaaccaaagacgcaacccctcagccggatattcttcctaaaagaacatttcctgaagccaacagagtgtgtctcacgagcatcagttcccagcactccacattaagagaagactggagatgccccaaaacagaggaaccacacaggcagggggtgaataatgtgaagccacctgcagttgcccctgagaaagatgaatctcctgttagcatttgtgaagatcatgaaatgaggaaccactctaaacctacctgcaggcttgtgccttcacagggagattccataagacaatgtatcctaacacgtgactcaagtattttcaagtataatcctgtcttaaacgatagtcaaaaaacacatgaaaacaacgaagacgatggagtcttggggtggaacattcagtgggttccgtgtgggagaaaaacagagctgaaatcaagcacatggactggcagtcagaacactgtgcatcatatacgtgatgaaattgatacgggggccaacaggcaccagcggaatccatttggaaaagctttccgtgaagacggatcccttagggcacacaacactcatggtcgagagaaaatgtatgattttactcagtgcgagaacacctccagaaataactcaattcacgccatgcagatgcagttgtataccgcagagacaaacaagaaggattgtcaaactggggcaacctctgccaacgctccaaattccggttcacacaagagtcattgcactggagagaaaacccataaatgccccgaatgtgggagagcctttttttatcagtcattccttatgagacatatgaaaattcacactggagagaaaccgtatgaatgtgggaaatgtgggaaagcctttagatattccttacaccttaataaacatttaagaaagcatgttgtgcagaagaagccctacgaatgtgaagaatgtgggaaagtcattcgggagtcctcaaaatatacacatataaggagccacactggagagaaaccctataaatgtaagacatgtggaaaagactttgcaaagtcgtcaggacttaaaaaacatcttaagactcacaaagatgagaagccctgtgaatgaaaggaaggtggaaaatttttcattaattttctgactgtaccaaacatgtgaggaggacatattggaagggagctcaaggggttagcatgagtgagaacatcttccctgaactctcgtatcttacagaaatgtgaaaaaaaaccctgtgaaggtaaagtctacagaaagcctttcatcttcattcatcttgagtagacatttgttctcaccctggagagaaactgcgaatctaaaaggaatatgacaaagccttcagcgtggtctcaaattcatggttcatacaagaactcacactgcagagactccttacggaaataaaaaatgtaggaaagacctgccggccgcggtggctcatgcctgtaatcccagcactttgggaggccgaggcgggcggatcacgaggtcaggagatcaagaccatcctggctaacacggtgataccccgtctctactaaaaatacaaaaaaaattagccaggcgtggtggcaggtgcctgtagtcccagctacttgggaggctgaggtaggagaatggtgtaaacctgggaggtggagcttgcagtgagccgagatggagccactgcactccagcctgggggaaagagcgagactccgtctcaaaaaaaaaaaaaagtaggaaagacctctttaaacacttaccactcatgttgcatgtgaatccacatcctgaagggaggctacaactggaataaaaataagaaagctttc

SEQ ID NO: 34809 - DNA, 2478 bp, Homo sapiens
agcccacttgcacccaagtgaataaacagcctttgttgcttacacaaagcctgtttaggtggtcttctatacggacacgcgtgacacccaggagttcgagacgagtctgggcagcatatactgaggggaaaaaaaagccttctttccttgggaaatgcaggaagccagcaagcggccggagtctccggagcccgcaaggaggcgcgttggctgcgcagagagcgcgcttcccagctggagagcctaggaacggtggcgcgggcggaggcgacagcgaggacccaaggctggggtttcctgcttggatcaggagtgcctggggatttgatccccatcctggtgcagctccgagacgctcctgggctgcgcgcgcttttgggctgcgccaccgacagagacatctggaagccggagctagtggaagactctgcctcacctgcctccttgaaggaaacacggggaagccaggactggccgtcacgttggtgacaaatatgtcccaggactcggtgaccttcgcagacgtggctgtgaacttcaccaaagaggagtggaccctgctggacccagctcagaggaatctctacagagacgtgatgctggaaaattctaggaacttggcattcatagattgggcaactccatgtaaaaccaaagacgcaacccctcagccggatattcttcctaaaagaacatttcctgaagccaacagagtgtgtctcacgagcatcagttcccagcactccacattaagagaagactggagatgccccaaaacagaggaaccacacaggcagggggtgaataatgtgaagccacctgcagttgcccctgagaaagatgaatctcctgttagcatttgtgaagatcatgaaatgaggaaccactctaaacctacctgcaggcttgtgccttcacagggagattccataagacaatgtatcctaacacgtgactcaagtattttcaagtataatcctgtcttaaacgatagtcaaaaaacacatgaaaacaacgaagacgatggagtcttggggtggaacattcagtgggttccgtgtgggagaaaaacagagctgaaatcaagcacatggactggcagtcagaacactgtgcatcatatacgtgatgaaattgatacgggggccaacaggcaccagcggaatccatttggaaaagctttccgtgaagacggatcccttagggcacacaacactcatggtcgagagaaaatgtatgattttactcagtgcgagaacacctccagaaataactcaattcacgccatgcagatgcagttgtataccgcagagacaaacaagaaggattgtcaaactggggcaacctctgccaacgctccaaattccggttcacacaagagtcattgcactggagagaaaacccataaatgccccgaatgtgggagagcctttttttatcagtcattccttatgagacatatgaaaattcacactggagagaaaccgtatgaatgtgggaaatgtgggaaagcctttagatattccttacaccttaataaacatttaagaaagcatgttgtgcagaagaagccctacgaatgtgaagaatgtgggaaagtcattcgggagtcctcaaaatatacacatataaggagccacactggagagaaaccctataaatgtaagacatgtggaaaagactttgcaaagtcgtcaggacttaaaaaacatcttaagactcacaaagatgagaagccctgtgaatgaaaggaaggtggaaaatttttcattaattttctgactgtaccaaacatgtgaggaggacatattggaagggagctcaaggggttagcatgagtgagaacatcttccctgaactctcgtatcttacagaaatgtgaaaaaaaaccctgtgaaggtaaagtctacagaaagcctttcatcttcattcatcttgagtagacatttgttctcaccctggagagaaactgcgaatctaaaaggaatatgacaaagccttcagcgtggtctcaaattcatggttcatacaagaactcacactgcagagactccttacggaaataaaaaatgtaggaaagacctgccggccgcggtggctcatgcctgtaatcccagcactttgggaggccgaggcgggcggatcacgaggtcaggagatcaagaccatcctggctaacacggtgataccccgtctctactaaaaatacaaaaaaaattagccaggcgtggtggcaggtgcctgtagtcccagctacttgggaggctgaggtaggagaatggtgtaaacctgggaggtggagcttgcagtgagccgagatggagccactgcactccagcctgggggaaagagcgagactccgtctcaaaaaaaaaaaaaagtaggaaagacctctttaaacacttaccactcatgttgcatgtgaatccacatcctgaagggaggctacaactggaataaaaataagaaagctttcaa

SEQ ID NO: 34810 - DNA, 2874 bp, Homo sapiens
gactaatggccctaactaagtattaacccctgccaagaaaagagctacttcctcttgaagtaaatgaagatagtgatgctttctcttaaactttacttataaaaagcatcaaaggggggaatgaagcaggaaatataaaaggaaaaacaagtaaagggaaaacaagtcctttcctgaccagtctgactcactccaaagtcctgctggagctatgataattatctgcaaggccaggcaggggctccgaaggagtgggctccaggagcagggatgagaaaaacaagttctccttatcagtttccctgtttgaaattctctccccataacattattctttgttctgctctcacaactatttttgtaactatttctgcaagtctgtaaagattttgtaagttcttgtttttctttctgtagcatggcaaggtcacaagacatgtttaagtaaggtaggctcatgttgcaaatcctgttgtaaaacctgtcacggtatgattaactgcctttgttctgcttctgtaagactgctttctcacctcgcaggttttgcgccaaaaacccgacttgcccctgcctgatgcatgtataaaagtcaagccctgtctttgttcagggctcagcctttggatgttaatccgctgggccagtggccacctaaataaaaccttcctgttgcacccagtgatctctccggcctcctgattcccacaacatataagcattcctttttctctgcaacctagcccgcatctgtcattgactttttaacaataggcattctgactggatgagatggtatctcactgtggtttttctctgcatttttctaataattaacaacgtgaattttgttttcatatgcttgtcagccacatgtatgtcttcttttgaaaagtatctgttcatgtttttgcttactttttaattaggtttttggttttctttttgttgttgttgttgttttctgagatggagtcttgctgtgtcaccaggatggagtgcagtggcatgatctcgactcactgcaacctccacctcccaggttcagatgattcttctgcttcagtctcctgagtagctgggatcacagggaccattgacatttatggatgtggccatagaattctctttggaggagtggcaatgcctggacactgcacagcagaatttatataggcatgtgatgtgagagaactacagaaacctggttttcttgggtgaaggtattgctgtctctaagccagacctgattacctgtctggagcaaggaaaagagccctggaatatgaagagacatgagatggtagctaaacatttagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtggtaaagcctttaaccagtcctcaacccttactacacataagagaattcatagtggagagaagccctacaaatgtgaagaatgtggcaaagcttttaaacaattttcaaatcttactgaccataaaaaaattcatactggagagaaaccctacaaatgtgaggaatgtggcaaagcttttaaccaactctcaaaccttactagacataaggtaattcatactggagagaaaccctacaaatgtggagaatgtggcaaagcctttaaccagtcctcagcccttaatacacataagataatccatactggagagaatccccacaaatgtagagaatctggcaaagttttccacctatcctcaaaacttagtacatgtaagaaaattcatactggagagaaactctacaaatgtgaagaatgtggcaaagcctttaaccgatcttcaacccttattggacataagagaattcatactggagagaaaccctacaaatgtgaagaatgtggcaaagcttttaaccaatcttcaacacttactacacataagataattcatactgaagagaaacagtacaaatgtgatgaatgtggcaaagcttctacctgatcctcaaaactcattgaacacaagaaaattcatactggagagaaaccttacaagtgtgaagaatgtggcaaaacttctaaccatttctcaacccttactaaacataagatgattcatactggagagaagttacacaa

SEQ ID NO: 34811 - DNA, 2437 bp, Homo sapiens
gactaatggccctaactaagtattaacccctgccaagaaaagagctacttcctcttgaagtaaatgaagatagtgatgctttctcttaaactttacttataaaaagcatcaaaggggggaatgaagcaggaaatataaaaggaaaaacaagtaaagggaaaacaagtcctttcctgaccagtctgactcactccaaagtcctgctggagctatgataattatctgcaaggccaggcaggggctccgaaggagtgggctccaggagcagggatgagaaaaacaagttctccttatcagtttccctgtttgaaattctctccccataacattattctttgttctgctctcacaactatttttgtaactatttctgcaagtctgtaaagattttgtaagttcttgtttttctttctgtagcatggcaaggtcacaagacatgtttaagtaaggtaggctcatgttgcaaatcctgttgtaaaacctgtcacggtatgattaactgcctttgttctgcttctgtaagactgctttctcacctcgcaggttttgcgccaaaaacccgacttgcccctgcctgatgcatgtataaaagtcaagccctgtctttgttcagggctcagcctttggatgttaatccgctgggccagtggccacctaaataaaaccttcctgttgcacccagtgatctctccggcctcctgattcccacaacatataagcattcctttttctctgcaacctagcccgcatctgtcattgactttttaacaataggcattctgactggatgagatggtatctcactgtggtttttctctgcatttttctaataattaacaacgtgaattttgttttcatatgcttgtcagccacatgtatgtcttcttttgaaaagtatctgttcatgtttttgcttactttttaattaggtttttggttttctttttgttgttgttgttgttttctgagatggagtcttgctgtgtcaccaggatggagtgcagtggcatgatctcgactcactgcaacctccacctcccaggttcagatgattcttctgcttcagtctcctgagtagctgggatcacagggaccattgacatttatggatgtggccatagaattctctttggaggagtggcaatgcctggacactgcacagcagaatttatataggcatgtgatgtgagagaactacagaaacctggttttcttgggtgaaggtattgctgtctctaagccagacctgattacctgtctggagcaaggaaaagagccctggaatatgaagagacatgagatggtagctaaacatttagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtggtaaagcctttaaccagtcctcaacccttactacacataagagaattcatagtggagagaagccctacaaatgtgaagaatgtggcaaagcttttaaacaattttcaaatcttactgaccataaaaaaattcatactggagagaaaccctacaaatgtgaggaatgtggcaaagcttttaaccaactctcaaaccttactagacataaggtaattcatactggagagaaaccctacaaatgtggagaatgtggcaaagctaacctatcatcaacccttactccacataagacaattcatatttga

SEQ ID NO: 34812 - DNA, 2027 bp, Homo sapiens
tcctgtgcgtccccaggtcaccgctcgccctagttcccaggctttggcctccggtgggcgagaatcgcggagcctgcggggctgggcgccgaagagccgggccggcacccaagcgggcgcggggctgtgcgggccaggcggaggctcaagcggggatccccgagcacgacccccggagccgacggcgctggggcccaaggggccggccgggcggtgacgacggcggaggcgaaggggcggcgggacccgggcccggcccgtgtgcgtcctcgacggcccggccccggctccgcaggacggtgagccccagggagacggatctgggctccgggagggacgccccgcctggatttgtcccgtaggcccggcccgggcccctctggagcagaacggccttggtgaggtggacaggaagggacctcgcgagcagacgcgcgcccgcgacagcaatcccgccccggcctgtcgggagcggtggggcagaggctgcggagccccaggaggatctgcctccgctttcacagtcctccagatttttccaagagcagcagaaaatgaataaatccctggggccagtgtcattcaaggacgtggctgtggacttcacccaggaggaatggcagcagctggatcctgagcagaagataacttacagggatgtgatgctggagaactacagcaatctagtttctgtggggtatcacattatcaaaccggatgttatcagcaagttggagcaaggagaagagccatggatagtagaaggagaattcctacttcagagctatccagatgaagtctggcaaactgatgacctaatagagagaatccaggaagaggaaaataaaccttcaaggcaaactgtgttcattgagaccctgattgaagagagaggtaatgttcctggtaaaacttttgatgtagaaacgaaccctgttccttcaagaaaaatagcctataaaaatagcctctgtgactcatgtgaaaagtgtttaacgtctgtttcagaatatattagtagtgatggaagctatgcaagaatgaaagctgatgaatgtagtggatgtgggaaatcactcctccatattaagcttgagaaaactcatccaggagatcaagcttatgaatttaatcaaaatggggaaccttatactctaaatgaagaaagtctttatcagaaaattcgtattttggagaaaccttttgaatatattgaatgccagaaagccttccaaaaggacactgtttttgttaatcacatggaagaaaagccctataagtggaatggatctgaaatagcctttctccagatgtcggacctcactgtacatcagacatctcatatggaaatgaagccctatgaatgcagtgaatgtgggaaatccttctgtaaaaagtcaaaatttattatacatcagaggactcacacaggagagaaaccttacgaatgtaatcagtgtgggaaatccttctgccagaagggaacccttactgtgcatcagagaacacacacaggggagaagccctatgaatgtaatgaatgtgggaagaacttttaccagaagttacacctcattcagcatcagagaactcactcaggagagaagccctatgaatgtagttattgtggaaaatccttttgccagaagacacacctcacacaacatcagagaacacattcaggagagagaccttatgtttgtcatgactgtgggccttctcgcagaagtcagcacttaatgcatcagaaaattcacacaggtgtgaaactctacaagtgtagtgaatgtgggaaatgcttctgccgcaagtctactctcacgacccacctgaggacccacacaggagagaaaccgtatgaatgtaatgagtgtggaaaattcttctctcggttgtcatatctcactgtacattatagaactcattcaggagagaaaccctatgaatgtaatgaatgtggaaaaaccttctacctgaattcagccctcatgagacatcagagagtgcacacaggagagaaaccttac

SEQ ID NO: 34813 - DNA, 2921 bp, Homo sapiens
ccaggtcaccgctcgccctagttcccaggctttggcctccggtgggcgagaatcgcggagcctgcggggctgggcgccgaagagccgggccggcacccaagcgggcgcggggctgtgcgggccaggcggaggctcaagcggggatccccgagcacgacccccggagccgacggcgctggggcccaaggggccggccgggcggtgacgacggcggaggcgaaggggcggcgggacccgggcccggcccgtgtgcgtcctcgacggcccggccccggctccgcaggacggtgagccccagggagacggatctgggctccgggagggacgccccgcctggatttgtcccgtaggcccggcccgggcccctctggagcagaacggccttggtgaggtggacaggaagggacctcgcgagcagacgcgcgcccgcgacagcaatcccgccccggcctgtcgggagcggtggggcagaggctgcggagccccaggaggatctgcctccgctttcacagtcctccagatttttccaagagcagcagaaaatgaataaatccctggggccagtgtcattcaaggacgtggctgtggacttcacccaggaggaatggcagcagctggatcctgagcagaagataacttacagggatgtgatgctggagaactacagcaatctagtttctgtggggtatcacattatcaaaccggatgttatcagcaagttggagcaaggagaagagccatggatagtagaaggagaattcctacttcagagctatccagatgaagtctggcaaactgatgacctaatagagagaatccaggaagaggaaaataaaccttcaaggcaaactgtgttcattgagaccctgattgaagagagagaatatattagtagtgatggaagctatgcaagaatgaaagctgatgaatgtagtggatgtgggaaatcactcctccatattaagcttgagaaaactcatccaggagatcaagcttatgaatttaatcaaaatggggaaccttatactctaaatgaagaaagtctttatcagaaaattcgtattttggagaaaccttttgaatatattgaatgccagaaagccttccaaaaggacactgtttttgttaatcacatggaagaaaagccctataagtggaatggatctgaaatagcctttctccagatgtcggacctcactgtacatcagacatctcatatggaaatgaagccctatgaatgcagtgaatgtgggaaatccttctgtaaaaagtcaaaatttattatacatcagaggactcacacaggagagaaaccttacgaatgtaatcagtgtgggaaatccttctgccagaagggaacccttactgtgcatcagagaacacacacaggggagaagccctatgaatgtaatgaatgtgggaagaacttttaccagaagttacacctcattcagcatcagagaactcactcaggagagaagccctatgaatgtagttattgtggaaaatccttttgccagaagacacacctcacacaacatcagagaacacattcaggagagagaccttatgtttgtcatgactgtgggaaaaccttctcgcagaagtcagcacttaatgaccatcagaaaattcacacaggtgtgaaactctacaagtgtagtgaatgtgggaaatgcttctgccgcaagtctactctcacgacccacctgaggacccacacaggagagaaaccgtatgaatgtaatgagtgtggaaaattcttctctcggttgtcatatctcactgtacattatagaactcattcaggagagaaaccctatgaatgtaatgaatgtggaaaaaccttctacctgaattcagccctcatgagacatcagagagtgcacacaggagagaaaccttacgaatgtaatgaatgtggaaagttattctcccagttgtcatacctcactatccatcatagaactcattcaggagtaaaaccctatgaatgtagtgaatgtgggaaaaccttctaccagaactcagccctttgtagacatcggagaatacacaaaggagagaagccctatgaatgctatatatgtggaaaattcttctctcagatgtcatacctcactatacatcatagaattcattcaggagagaagccctatgaatgtagtgaatgtgggaaaaccttctgccagaattcagcccttaatcgacatcagagaacacacacaggagagaaagcctacgaatgttatgaatgtgggaagtgcttctctcagatgtcctatctcactatacatcatcgaattcattcaggagagaaaccctttgaatgtaatgagtgtggaaaagccttctctcggatgtcatacctcactgtacattatagaactcattcaggagagaaaccctatgagtgtactgaatgtggaaaaaaattctaccacaaatcagcattcaacagccatcagagaattcataggagaggcaatatgaatgtaatagatgtgggaaggcttctctgaagtcagacctcattttatatcagagaaccctttcagtatagtgaatcagaaactcctgcctgaagtcaaacaccttgtacatcagagagttcacacaggttagtgtggacatccccttgtgtgttggactcataatctgaagactcacagaatggaaaccatgattataacaagaccacatggtataacaatactagactatagacaagtaaaaatttataaatattaagaatgtatatacatgtcaccatggattggaactgttttgcatatcagggaaatcatagccaaggggaaatctatcagtataaggaatgtggaagacataatcctttggaaactgttaatactaaaagatatgtttctgatacaatagcaaacttgaaaaaaaaaaaagaa

SEQ ID NO: 34814 - DNA, 2405 bp, Homo sapiens
cccctctctgtgtgcgtgttcgcgcatgcgcgcaacggccttggtgaggtggacaggaagggacctcgcgagcagacgcgcgcccgcgacagcaatcccgccccggcctgtcgggagcggtggggcagaggctgcggagccccaggaggatctgcctccgctttcacagtcctccagatttttccaagagcagcagaaaatgaataaatccctggggccagtgtcattcaaggacgtggctgtggacttcacccaggaggaatggcagcagctggatcctgagcagaagataacttacagggatgtgatgctggagaactacagcaatctagtttctgtggggtatcacattatcaaaccggatgttatcagcaagttggagcaaggagaagagccatggatagtagaaggagaattcctacttcagagctatccagatgaagtctggcaaactgatgacctaatagagagaatccaggaagaggaaaataaaccttcaaggcaaactgtgttcattgagaccctgattgaagagagaggtaatgttcctggtaaaacttttgatgtagaaacgaaccctgttccttcaagaaaaatagcctataaaaatagcctctgtgactcatgtgaaaagtgtttaacgtctgtttcagaatatattagtagtgatggaagctatgcaagaatgaaagctgatgaatgtagtggatgtgggaaatcactcctccatattaagcttgagaaaactcatccaggagatcaagcttatgaatttaatcaaaatggggaaccttatactctaaatgaagaaagtctttatcagaaaattcgtattttggagaaaccttttgaatatattgaatgccagaaagccttccaaaaggacactgtttttgttaatcacatggaagaaaagccctataagtggaatggatctgaaatagcctttctccagatgtcggacctcactgtacatcagacatctcatatggaaatgaagccctatgaatgcagtgaatgtgggaaatccttctgtaaaaagtcaaaatttattatacatcagaggactcacacaggagagaaaccttacgaatgtaatcagtgtgggaaatccttctgccagaagggaacccttactgtgcatcagagaacacacacaggggagaagccctatgaatgtaatgaatgtgggaagaacttttaccagaagttacacctcattcagcatcagagaactcactcaggagagaagccctatgaatgtagttattgtggaaaatccttttgccagaagacacacctcacacaacatcagagaacacattcaggagagagaccttatgtttgtcatgactgtgggaaaaccttctcgcagaagtcagcacttaatgaccatcagaaaattcacacaggtgtgaaactctacaagtgtagtgaatgtgggaaatgcttctgccgcaagtctactctcacgacccacctgaggacccacacaggagagaaaccgtatgaatgtaatgagtgtggaaaattcttctctcggttgtcatatctcactgtacattatagaactcattcaggagagaaaccctatgaatgtaatgaatgtggaaaaaccttctacctgaattcagccctcatgagacatcagagagtgcacacaggagagaaaccttacgaatgtaatgaatgtggaaagttattctcccagttgtcatacctcactatccatcatagaactcattcaggagtaaaaccctatgaatgtagtgaatgtgggaaaaccttctaccagaactcagccctttgtagacatcggagaatacacaaaggagagaagccctatgaatgctatatatgtggaaaattcttctctcagatgtcatacctcactatacatcatagaattcattcaggagagaagccctatgaatgtagtgaatgtgggaaaaccttctgccagaattcagcccttaatcgacatcagagaacacacacaggagagaaagcctacgaatgttatgaatgtgggaagtgcttctctcagatgtcctatctcactatacatcatcgaattcattcaggagagaaaccctttgaatgtaatgagtgtggaaaagccttctctcggatgtcatacctcactgtacattatagaactcattcaggagagaaaccctatgagtgtactgaatgtggaaaaaaattctaccacaaatcagcattcaacagccatcagagaattcataggagaggcaatatgaatgtaatagatgtgggaaggcttctctgaagtcagacctcattttatatcagagaaccctttcagtatagtgaatcagaaactcctgcctgaagtcaaacaccttgtacatcagagagttcacacaggttagtgtggacat

SEQ ID NO: 34815 - DNA, 5051 bp, Homo sapiens
ccaggtcaccgctcgccctagttcccaggctttggcctccggtgggcgagaatcgcggagcctgcggggctgggcgccgaagagccgggccggcacccaagcgggcgcggggctgtgcgggccaggcggaggctcaagcggggatccccgagcacgacccccggagccgacggcgctggggcccaaggggccggccgggcggtgacgacggcggaggcgaaggggcggcgggacccgggcccggcccgtgtgcgtcctcgacggcccggccccggctccgcaggacggtgagccccagggagacggatctgggctccgggagggacgccccgcctggatttgtcccgtaggcccggcccgggcccctctggagcagaacggccttggtgaggtggacaggaagggacctcgcgagcagacgcgcgcccgcgacagcaatcccgccccggcctgtcgggagcggtggggcagaggctgcggagccccaggaggatctgcctccgctttcacagtcctccagatttttccaagagcagcagaaaatgaataaatccctggggccagtgtcattcaaggacgtggctgtggacttcacccaggaggaatggcagcagctggatcctgagcagaagataacttacagggatgtgatgctggagaactacagcaatctagtttctgtggggtatcacattatcaaaccggatgttatcagcaagttggagcaaggagaagagccatggatagtagaaggagaattcctacttcagagctatccagatgaagtctggcaaactgatgacctaatagagagaatccaggaagaggaaaataaaccttcaaggcaaactgtgttcattgagaccctgattgaagagagaggtaatgttcctggtaaaacttttgatgtagaaacgaaccctgttccttcaagaaaaatagcctataaaaatagcctctgtgactcatgtgaaaagtgtttaacgtctgtttcagaatatattagtagtgatggaagctatgcaagaatgaaagctgatgaatgtagtggatgtgggaaatcactcctccatattaagcttgagaaaactcatccaggagatcaagcttatgaatttaatcaaaatggggaaccttatactctaaatgaagaaagtctttatcagaaaattcgtattttggagaaaccttttgaatatattgaatgccagaaagccttccaaaaggacactgtttttgttaatcacatggaagaaaagccctataagtggaatggatctgaaatagcctttctccagatgtcggacctcactgtacatcagacatctcatatggaaatgaagccctatgaatgcagtgaatgtgggaaatccttctgtaaaaagtcaaaatttattatacatcagaggactcacacaggagagaaaccttacgaatgtaatcagtgtgggaaatccttctgccagaagggaacccttactgtgcatcagagaacacacacaggggagaagccctatgaatgtaatgaatgtgggaagaacttttaccagaagttacacctcattcagcatcagagaactcactcaggagagaagccctatgaatgtagttattgtggaaaatccttttgccagaagacacacctcacacaacatcagagaacacattcaggagagagaccttatgtttgtcatgactgtgggaaaaccttctcgcagaagtcagcacttaatgaccatcagaaaattcacacaggtgtgaaactctacaagtgtagtgaatgtgggaaatgcttctgccgcaagtctactctcacgacccacctgaggacccacacaggagagaaaccgtatgaatgtaatgagtgtggaaaattcttctctcggttgtcatatctcactgtacattatagaactcattcaggagagaaaccctatgaatgtaatgaatgtggaaaaaccttctacctgaattcagccctcatgagacatcagagagtgcacacaggagagaaaccttacgaatgtaatgaatgtggaaagttattctcccagttgtcatacctcactatccatcatagaactcattcaggagtaaaaccctatgaatgtagtgaatgtgggaaaaccttctaccagaactcagccctttgtagacatcggagaatacacaaaggagagaagccctatgaatgctatatatgtggaaaattcttctctcagatgtcatacctcactatacatcatagaattcattcaggagagaagccctatgaatgtagtgaatgtgggaaaaccttctgccagaattcagcccttaatcgacatcagagaacacacacaggagagaaagcctacgaatgttatgaatgtgggaagtgcttctctcagatgtcctatctcactatacatcatcgaattcattcaggagagaaaccctttgaatgtaatgagtgtggaaaagccttctctcggatgtcatacctcactgtacattatagaactcattcaggagagaaaccctatgagtgtactgaatgtggaaaaaaattctaccacaaatcagcattcaacagccatcagagaattcataggagaggcaatatgaatgtaatagatgtgggaaggcttctctgaagtcagacctcattttatatcagagaaccctttcagtatagtgaatcagaaactcctgcctgaagtcaaacaccttgtacatcagagagttcacacaggttagtgtggacatccccttgtgtgttggactcataatctgaagactcacagaatggaaaccatgattataacaagaccacatggtataacaatactagactatagacaagtaaaaatttataaatattaagaatgtatatacatgtcaccatggattggaactgttttgcatatcagggaaatcatagccaaggggaaatctatcagtataaggaatgtggaagacataatcctttggaaactgttaatactaaaagatatgtttctgatacaatagcaaacttgaaaaaaaaaaaagaaatagaagattcctgctgtgaataaacatacttcttgtgtaaatagaaactgtaaagtcatcaggatagctagttaagtcggtaaccttaaactcatgtaagcagttcccaaagaacataggacttatgtttggggagagggttgtttttattacagtacattacaggaattgtatgttcacttcgaatcatgtttgaaaaaacgttgtatccttattttgtaattcatatagtaagagtattctaaacagcactacattaatatcatttgataggtataaagtatactttttcttgcactcttctctaggatttaatgcattgatcattcttaatgaacaatatcagctctaaaggaccaatgcttttataatgttttcaactgtatctgagtcagccagagagataaatatccatgtataaaatagatagaaaactttgcttggtaatttaaaattaataatgccagttttccaagagtgagaaaatcattgcactctatacagttttaagatatacttaaaatattcccatttgtatctatttttttttctactgttttttatttggacacttacataacagtgcagagcacaatgctgtgtaacataggaattcactgtgttttcatttgatgtcgtactggttttaaaccttgtgctctactccttcctgttaatgaattaagaacacattctaacaagggtctgtggcagacattgccgagtgactttctaacataggaattcactgtgttttcatttgatgtcgtactggttttaaaccttgtgctctactccttcctgttaatgaattaagaacacattctaacaagggtctgtggcagacattgccgagtgactttcttagtcactcccttactctgctggcggagtttggttatccatttatcctcaaaaggaagtgagataaatcctgattagttttaaccagtgacactccccttctcgttgccagcagttgatttacagtggtcacagggcccaattctagacataaaacaaaggatatacctgacagactacttctggaaaaggttttctcaaaggcccaaggattcaagcaaagggaagtggaatcttgtggtgaacagtaccttgtctggatgtggtgcctggtaaccatctttcagcaatggattatagtttaatcatggcctgagcagaaatactgaaagaccctgagacctggatgatgtctttgagccaccaaaccaagcagccttgtagccactcctcctttggactgtttcttttgtgagagactaaacttatttttaagccagttgatttaggatgctctattactaataactgaagacattctaattggtacagactgaaacctttataggagttatgcagttcagaagtggactttaggtaagtcatttattttaagctgttgatatagagatttattttctgtaaattttgacgtaaatagtttgagcattagaaatcaacttgaaacaataaaatgtatgcttccttgaactgtcatatcgttgacctgcaaaattcacctttggaacgtgacacaatgttaggcatacctccttttttctaatacatggaatacattttgttggaggtaatttatgtgattcatataccactgctacagtgttagctgacaacatatagtatgaggtaaggatctaattctgtttcctctcacatgattacttgatagctaagcatctgattggtttactgctttaccactgagctgaaatgccgtgttttccatttattaaaatcacacatggctcctgtttttgtcactcagcactttttctccatattcttcaagacgattgtgagtatggtacgtaacaggaattacatctggtaagttgtatagttttgtgtaggaactctatattcatagcatatttgtggaaatgatacctatggaggtttctcacactggtgtgtcattatacattaattgtacaatatgcattttcagtaaaatatttgaaaactgtaaa

SEQ ID NO: 34816 - DNA, 1729 bp, Homo sapiens
atcttttccggcgctggctccgcatggtcagtgccatttcgcctttatcgtggtggagtccaccctggctgtggacctattcaaactcagtctgtctcttgactggaggaggagaaggaaaagttgagcacattgccaaccggagttccccaagaatggcaagttaaaaccaaagtgtcagcacctcaacaacatttttttttggcttaacaaaacatcaaacggcatacaaatggcagaaatccacaatggaggggaactctgtgactttatggaaaatggagaaatcttcagtgaacactcatgccttaatgcacacatgggaactgaaaatacaggggacacttatgactgtgatgagtatggagaaaactttcccatgttacacaacagtgcccctgctggagagacactttctgtgttgaatcagtgcagaaaagccttcagcctgccaccaaatgttcaccagagaacgtggataggagacaaatcctttgaatacagtgactgtgaggaagcctttgttgatcagtcacatcttcaggcaaataggataactcacaatggagaaacactctatgaacagaagcaatgtgggagagcttttacttactccacaagccatgctgtgtctgttaaaatgcatactgtagaaaaaccctacgaatgtaaggaatgtggaaaattctttagatattcttcatatcttaatagtcacatgcgaacccatactggggagaaaccctatgaatgtaaggaatgtgggaaatgcttcactgtttcttcacacctagttgaacatgtaagaattcatactggagagaaaccttatcaatgtaaggaatgtggaagagccttcgctgggcgctcaggccttactaaacatgtacgaatacacactggagagaagccctatgaatgtaacgaatgtgggaaagcctacaataggttttatctactaactgaacattttaaaactcacacagaggagaagccctttgaatgtaaggtatgtggaaaatccttcagaagctcttcatgccttaagaatcactttagaattcacactggaataaaaccctataaatgtaaggagtgtgggaaagcattcactgtttcctcaagcttacataatcatgtaaaaatccatactggagagaagccctatgaatgtaaggactgtgggaaagcctttgctacatcttcacaactcattgaacatataagaactcacactggagagaaaccgtatatatgtaaggaatgtgggaaaaccttccgtgcttcttcacatctacagaaacatgttagaattcacactggagagaaaccctatatatgtaacgaatgtgggaaagcctacaatagattttatttacttactaaacatttaaaaacacactgaagaaaaactctgaatgtaaggaatgtggaaatcttttaggaatttctcataccataattaccacatttgaattcacactgaagagaaattttattggtacaaagaatgtgaggaggccttcagttatccccattcacttcgaagacatgaaagaactcatactctatgtgtcccctataaattttaggaatgttagggagccaatggaatctttttttattattttattttattttattttattttattttattttattttattttatttgagacagagttttgctgttgtcatcacacaggctggagtgcaatggcatgatcc

SEQ ID NO: 34817 - DNA, 1546 bp, Homo sapiens
ccggcgctggctccgcatggtcagtgccatttcgcctttatcgtggtggagtccaccctggctgtggacctattcaaactcagtctgtctcttgactggaggaggagaaggaaaagttgagcacattgccaaccggagttccccaagaatggcaagttaaaaccaaagtgtcagcacctcaacaacatttttttttggcttaacaaaacatcaaacggcatacaaatgatgggactgtctagttgcaggaaaacaagctcaggcctcctgctgatcctattttatggcagaaatccacaatggaggggaactctgtgactttatggaaaatggagaaatcttcagtgaacactcatgccttaatgcacacatgggaactgaaaatacaggggacacttatgactgtgatgagtatggagaaaactttcccatgttacacaacagtgcccctgctggagagacactttctgtgttgaatcagtgcagaaaagccttcagcctgccaccaaatgttcaccagagaacgtggataggagacaaatcctttgaatacagtgactgtgaggaagcctttgttgatcagtcacatcttcaggcaaataggataactcacaatggagaaacactctatgaacagaagcaatgtgggagagcttttacttactccacaagccatgctgtgtctgttaaaatgcatactgtagaaaaaccctacgaatgtaaggaatgtggaaaattctttagatattcttcatatcttaatagtcacatgcgaacccatactggggagaaaccctatgaatgtaaggaatgtgggaaatgcttcactgtttcttcacacctagttgaacatgtaagaattcatactggagagaaaccttatcaatgtaaggaatgtggaagagccttcgctgggcgctcaggccttactaaacatgtacgaatacacactggagagaagccctatgaatgtaacgaatgtgggaaagcctacaataggttttatctactaactgaacattttaaaactcacacagaggagaagccctttgaatgtaaggtatgtggaaaatccttcagaagctcttcatgccttaagaatcactttagaattcacactggaataaaaccctataaatgtaaggagtgtgggaaagcattcactgtttcctcaagcttacataatcatgtaaaaatccatactggagagaagccctatgaatgtaaggactgtgggaaagcctttgctacatcttcacaactcattgaacatataagaactcacacctgtaatcccagcaccttgagaggctgaggtgagtgaatcatgaggtcaggagttcgagaccagcctggccaccatggtgaaaccccgtctctactaaaaatacaaaaaattagccgggcatggtggcaggcacctatagtcccagctattcaggaggctgaggcaggagaatcacttgaatccaggaggtggaggttagagtgagctgagatcacaccactgcactccagcccaggtgacagagtgagattccttctc

SEQ ID NO: 34818 - DNA, 1678 bp, Homo sapiens
tctctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagttcatttcagatacatcagagaaatcacactggagagaaaccctatgaatgtatggaatgtgggaaagccttaggtttttcccgttctcttaatagacataaaaggattcacactggagaaaaacgctatgaatgtaagcaatgtgggaaagccttcagtcgttccagtcaccttcgtgaccatgaaagaactcatactggagagaaaccctatgaatgtaagcactgtgggaaagccttccgttactccaattgccttcattaccatgaaagaactcacactggagagaaaccttatgtgtgcatggaatgtggcaaagctttcagttgtctcagttccttgcaaggacatataaaggctcatgctggtgaagaaccctatccatgtaagcaatgtgggaaagccttcagatacgccagttcccttcagaaacacgagaaaactcatattgcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaaaggctttaatcactacagtttttgtcaaaaacatgaacagtcacatacttgagagaaactgtgaatgtaaggtgtaggaaagtacttaattttcccagatttcctcaaatacatgaaacgaatcaaactggagataaaccctatgactataagcaataaggtaaagcattcaatttttccatttctttttgaaaacttgaaaggactcactgaagaaaatccatatgaatgtttaaaatgtggtaaggcctgcagttgttccagtggtatttgatggtataacataactcattctagagaaaaactttatgaaggtatcgaatgtgagaatgccttcatttatcctataactcactcagagacacatggtaacacatactccagattgaccttataaataaaagaatgcccaccagattgaaatcctagaaatacagaaaattctgaattttaacaattactttaaaggtcatgtgaaaactcccactggaaataaatcctgtaaatgtaaatattatggaaaaccttatggaaaataattatagtacaattctcaagaaaattcactatgtgaatgagatgttttaggagctataaataaattgaatatattggttgctcatttttgaagagagtctctagaatatagattttcacttcttttgaaaaaaaaaaaa

SEQ ID NO: 34819 - DNA, 2078 bp, Homo sapiens
ttttttttttttttttaacaatcggatctttcaggaactaatagagcgagaagtcactcattaccacaacagtgccacttatgtggaatctgctcccatgacccaagcacctcacaccaggtcatacctccaacatgaggatcaaatttcagcatgaaatttgaagggagaaaatacccaaactgtattcaatactaagaaactgcatatgagaatattactgtattgttaatagctataggggagggagccatgttgtagactaatcaatccatttatgttcaatttgtttatgttagaaaacctgcactttctctgatattggtagcagtgtaagttcagacttagtaataaaagaaaataactaataaaccattaatgatggggttgtcattttttgcagaagtcatatgatagacatactgtgtaaaattaaataagtcagtgtagaaaaacctccagatgccaaattttaatctgaacaaaaaaattcctgctagagtaaaaccacatgaatgcattgtgtgtgaaaaattcttcatacgtcattcatcccttcataggcacatcatatctcattctggaaacaacccatatgggtgtgaggaatgcggaaagaagccatgtacatgtaaacaatgtcagaaaacttccctttctgtcacaagggttcacagagacacagtaatgcacactggaaatggacattatggttgtacaatatgtgagaaagtttttaatattcccagttcatttcagatacatcagagaaatcacactggagagaaaccctatgaatgtatggaatgtgggaaagccttaggtttttcccgttctcttaatagacataaaaggattcacactggagaaaaacgctatgaatgtaagcaatgtgggaaagccttcagtcgttccagtcaccttcgtgaccatgaaagaactcatactggagagaaaccctatgaatgtaagcactgtgggaaagccttccgttactccaattgccttcattaccatgaaagaactcacactggagagaaaccttatgtgtgcatggaatgtggcaaagctttcagttgtctcagttccttgcaaggacatataaaggctcatgctggtgaagaaccctatccatgtaagcaatgtgggaaagccttcagatacgccagttcccttcagaaacacgagaaaactcatattgcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaaaggctttaatcactacagtttttgtcaaaaacatgaacagtcacatacttgagagaaactgtgaatgtaaggtgtaggaaagtacttaattttcccagatttcctcaaatacatgaaacgaatcaaactggagataaaccctatgactataagcaataaggtaaagcattcaatttttccatttctttttgaaaacttgaaaggactcactgaagaaaatccatatgaatgtttaaaatgtggtaaggcctgcagttgttccagtggtatttgatggtataacataactcattctagagaaaaactttatgaaggtatcgaatgtgagaatgccttcatttatcctataactcactcagagacacatggtaacacatactccagattgaccttataaataaaagaatgcccaccagattgaaatcctagaaatacagaaaattctgaattttaacaattactttaaaggtcatgtgaaaactcccactggaaataaatcctgtaaatgtaaatattatggaaaaccttatggaaaataattatagtacaattctcaagaaaattcactatgtgaatgagatgttttaggagctataaataaattgaatatattggttgctcatttttgaagagagtctctagaatatagattttcacttcttttgaaaaaaaaaaaa

SEQ ID NO: 34820 - DNA, 468 bp, Homo sapiens
atgaatgcattgtgtgtgaaaaattcttcataccattcatcccttcataggcacatcatatctcattctggaaacaacccatatgggtgtgaggaatgcggaaagaagccatgtacatgtaaacaatgtcagaaaacttccctttctgtcacaagggttcacagagacacagtaatgcacactggaaatggacattatggttgtacaatatgtgagaaagtttttaatattcccagttcatttcagatacatcagagaaatcacactggagagaaaccctatgaatgtatggaatgtgggaaagccttaggtttttcccgttctcttaatagacataaaaggattcacactggagaaaaacgctatgaatgtaagaaatgtggcaaagcctttagtcgtgctagtaccctttggaagcataaaaaaactcatactggagaaaagccctataaatgtaaaaaaatgtaa

SEQ ID NO: 34821 - DNA, 888 bp, Homo sapiens
atgaatgcattgtgtgtgaaaaattcttcataccattcatcccttcataggcacatcatatctcattctggaaacaacccatatgggtgtgaggaatgcggaaagaagccatgtacatgtaaacaatgtcagaaaacttccctttctgtcacaagggttcacagagacacagtaatgcacactggaaatggacattatggttgtacaatatgtgagaaagtttttaatattcccagttcatttcagatacatcagagaaatcacactggagagaaaccctatgaatgtatggaatgtgggaaagccttaggtttttcccgttctcttaatagacataaaaggattcacactggagaaaaacgctatgaatgtaagcaatgtgggaaagccttcagtcgttccagtcaccttcgtgaccatgaaagaactcatactggagagaaaccctatgaatgtaagcactgtgggaaagccttccgttactccaattgccttcattaccatgaaagaactcacactggagagaaaccttatgtgtgcatggaatgtggcaaagctttcagttgtctcagttccttgcaaggacatataaaggctcatgctggtgaagaaccctatccatgtaagcaatgtgggaaagccttcagatacgccagttcccttcagaaacacgagaaaactcatattgcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaa

SEQ ID NO: 34822 - DNA, 2243 bp, Homo sapiens
ctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaaaacggctcacgtaggccgggcgcagtggctcacgcctgtaatcccagcactttgggaggccgaggcgggcagatcacaaggtcaggagatcgagaccatcctggctaacacggtgaaaccccatctctactaaaaatacaaaaagtagccgggcgtggtggtggatgcctgcggtcccagctactcaggaggctgaggcaggagaatggcatgaacccgggaggcggagattgcagtgagccgagatcgcgccactgtactccagcctgcgtgacagagcgagactccgtctcagaaaaaaaaaaaaagaacataatatgtgtattgtgtctcatgtacactgttgaagaggtagcagcccatgattgatgaaatagtccagtgatcttatgagatacaagtttgttttcatgttctctctctgacattgtctatgcttagttattgtgttcatgcttattccttcatggtccaagttggctgtcccacctccaggcatcaaaccacattccaaacagcaaccaggaggaaatagtaagctgataggtcatggggaattaggttggaagccattgctttttaatttacagaagtccattctccccaggcacttctttctaagtctcattgatcagaactcaaccacgtggccaccatcagcagaaacatctctctgtagcaccgtgaaacacatgagaacataactggggatgaccgttgttacttgaactattttgaaagatctgacataaaggtcatcgccttgtgcacttcaatgggtgttactgcaaaactcccagggctaggcatggcgacatacacccgaaatctcagctatctgggaggctgaggtgggaggattgcttgagcccacgagtttgaggctgaagtgtgcctgtgaatagctactgcactccagtgcctaggacacatagggagacctcacttttttatggctgcatagtattccatggtaaagaaatgtaccacattttctttatccacttcactgttgatgggcatttatccacttcactgttggtgggaatttaggttgaatccatgtctttgctattgaagtcacactttttaatcaagttatttaactttcctgtgttcatttgtgttatataccagaacatttttatttctatggttttaatgccacctaatatgattatcaatgtgtcattctccataaatcattgtgttatacatgttaaacgattaggtattaagtgtataggtataaatcacttagaataatgactaacacattgtatgaactaaataagtactgattcatctgattcatcaaatttccattattcataccattcattatttattaagtggtgtagtatttgttcttatcaacatttgcttttctgtcctatctaaatattaatgaaacagtggatgtgggctcagtgtgctgtcttgaaataatccaaagtcaaatggcatgcttcactggtttcctttagatgcaataactcatttgactcacacaataaaaatgagtattaagta

SEQ ID NO: 34823 - DNA, 2400 bp, Homo sapiens
gcaagcctgggccgctcctccttccctcaagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgtt

SEQ ID NO: 34824 - DNA, 2502 bp, Homo sapiens
gcaagcctgggccgctcctccttccctcaagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggtattgaaattgtggaacttcagctgtcacatgtgaaggacttgttccattgtgagaaatgtaaccgttcatttaaattgttttaccattttaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgtt

SEQ ID NO: 34825 - DNA, 3125 bp, Homo sapiens
gagaagagggagggcgggggagggagaggcgacccgagagtcgttgtgggtcgcgggccggaccgggtcccggggcggtgggagccccggccgggcagaagggcttggcgggccgttagaggaccgccacggctgtcgagtcccctcccttgttggacttgcgcgccctggcgctcggaacctccggcgctgtgcccaccccgctctagctcgcgtctcccgactccaattagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaactgaacttctataaagcatctctggttctttcaaagtttgtgttgtaaggagcaatgtagatgatgctataatactttatatttttggttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaa

SEQ ID NO: 34826 - DNA, 501 bp, Homo sapiens
gtgacgcgcaagcctgggccgctcctccttccctcacccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaa

SEQ ID NO: 34827 - DNA, 2063 bp, Homo sapiens
gcggtgacggtgtgcgtcgacagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggtattgaaattgtggaacttcagctgtcacatgtgaaggacttgttccattgtgagaaatgtaaccgttcatttaaattgttttaccattttaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattc

SEQ ID NO: 34828 - DNA, 572 bp, Homo sapiens
ggccgggcagaagggcttggcgggccgttagaggaccgccacggctgtcgagtcccctcccttgttggacttgcgcgccctggcgctcggaacctccggcgctgtgcccaccccgctctagctcgcgtctcccgactccaattagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaa

SEQ ID NO: 34829 - DNA, 3340 bp, Homo sapiens
gaagagggagggcgggggagggagaggcgacccgagagtcgttgtgggtcgcgggccggaccgggtcccggggcggtgggagccccggccgggcagaagggcttggcgggccgttagaggaccgccacggctgtcgagtcccctcccttgttggacttgcgcgccctggcgctcggaacctccggcgctgtgcccaccccgctctagctcgcgtctcccgactccaattaggtcaggctcggagtcccgcggccgcggctccggtctcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaactgaacttctataaagcatctctggttctttcaaagtttgtgttgtaaggagcaatgtagatgatgctataatactttatatttttggttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccata

SEQ ID NO: 34830 - DNA, 1050 bp, Homo sapiens
gaacgtgctcgcgcccgtagctgccgctgccggggccgcggccgcccgggtgcccaaccgaacgcacgtgcgccagcggggcccgagcagaaggggagccccggctctcacgaagaaaatggagggcgacccacgggttaggggtcaggaaaggcgtggggcgcattatgccctgggaggggaaagcacggaacaagaggctctgagggacggagaggaaggagggcgacccacgagctagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcg

SEQ ID NO: 34831 - DNA, 3030 bp, Homo sapiens
gagccaatgaaagctcggaccagtggcaagtccgagctgtcattgagaggcgggacttccggcgccgccattgcggtcctcattttgctgctggtgggttgggctacagcaggcctctggagccacaccagggcacgggagtgggtgcagggaccgtcaccgcgccttcacacgcaccatagtgcccggctaattactctgcttttatgagccaaggtgttcccgaaagtggagccagcgccacgcgtctccagggtctccatacccagccttcgtccctgcggtgcccagaggccttgcgcgcattttgcatttgggaagacaggtcctgagtgcgaccgtcacccagcggaagtgtgagggttcggcccagcggcagggctagccctgggcctcctgttatggccctgcccagcccacaggttctaatggggttgccagcgttgctgatgggcccggcgcagcatacttcttggccctgtggctcagctgtccccacattgaagagcatggtaacctttgaagatgtggctgtatacttctcccaagaggagtgggagctccttgatgcagcccagaggcacctgtaccacagtgtgatgctggaaaaccttgagcttgtgacctcacttggttcttggcatggagtagagggtgagggggcccatcccaagcagaatgtttctgtagaagtgttacaggtcaggatccctaatgcagatccttccaccaagaaagctaactcctgtgacatgtgtgggccattcttgaaagacattttgcacctggctgagcatcagggaacacagtctgaggagaaaccctacacatgtggagcatgtgggagagacttttggttgaatgcaaaccttcaccagcaccagaaggagcacagtggagggaagccctttagatggtacaaggacagggacgcacttatgaagagctctaaagtccacctgtcagagaaccccttcacttgcagggaaggtgggaaggtcatcctgggcagctgtgacctcctccagcttcaagctgttgacagtgggcagaagccatattccaatcttgggcagcttccagaagtctgtaccacacagaaactcttcgagtgcagcaactgtggaaaagccttcctgaagagctccactctccccaaccatctgagaactcactctgaagagataccatttacatgcccaacaggtggaaatttcttagaggagaaatcaatccttggtaataaaaagtttcacactggggaaataccccatgtgtgtaaggagtgtgggaaggcctttagtcactcatctaagctgaggaagcaccagaaatttcacactgaagtaaaatattatgagtgcattgcatgtgggaaaaccttcaaccacaaactcacatttgttcatcatcagagaattcactcaggagaaagaccttatgagtgtgatgaatgtgggaaagccttcagtaacagatcacacctcattcggcatgagaaagttcacactggagaaaggccttttgagtgcctgaaatgtggaagagccttcagccaaagctccaatttccttcggcatcagaaagttcacacacaggtaagaccttatgagtgcagtcaatgtggtaaatccttcagccgaagctctgctctcattcagcactggagagttcacactggagaaagaccgtatgaatgcagtgaatgtggaagagcttttaacaataactccaaccttgctcagcaccagaaagttcacaccggagaacggccttttgagtgcagtgaatgtggaagagacttcagccaaagctcccatctccttcgacatcagaaagttcacactggagaacggccttttgaatgctgtgattgtggtaaagccttcagtaatagctccaccctcatccagcaccagaaagtacatactgggcaaaggccttatgagtgcagcgaatgtaggaaatccttcagccgcagctccagcctgattcagcactggagaattcacactggagaaaagccttacgagtgtagtgagtgtgggaaagcctttgctcacagctccactctcattgaacactggagagttcacacaaaagaaaggccttatgagtgcaatgaatgtgggaaattctttagccaaaactccattctcattaagcatcagaaagttcatactggagaaaagccttataaatgcagtgaatgtgggaaattctttagccgaaaatccagccttatttgtcactggagagttcacactggagaaaggccttacgaatgcagtgaatgtgggagagcctttagcagtaactcccacctggttcgtcatcagagagttcacacacaagaaaggccctatgagtgcatccagtgtggaaaagcctttagtgaaagatctacacttgttcggcaccagaaagttcacaccagagaaaggacttatgagtgtagccagtgtgggaaactcttcagccatctttgtaaccttgcacagcataaaaagattcatacctgagtggagccttatggaagtggtctttgtgagaaaatcttcagccaagtcaaacttcatgcagcagaatccccataccagaaaaattacctacatgtactgctaatgtggaaaagccttcagaagctactctgtttctgaccagcccaggaacctttgcagggccatctcacccatgcagcataaggcagaagccatagtcactttccatcttgcctggatccaaaaatttgcagcagtcctgtcctcatgcatggggaaaacagtaccctgagccttccttcctgtgttctctagggattcaggactgtgctcagctgaaccgatgctggttgaggggccttgagggaaatctaatttgagctcaggaagatgcacattccttgtggatgtggtcaagtctgtgtttaacccctaagatgtgtccattgaggccacaaatcaccctccactggaatcacctaccttgcctgcactaactggtgataataaagaccttattgatcaggtc

SEQ ID NO: 34832 - DNA, 1188 bp, Homo sapiens
cccacattgaagagcatggtaacctttgaagatgtggctgtatacttctcccaagaggagtgggagctccttgatgcagcccagaggcacctgtaccacagtgtgatgctggaaaaccttgagcttgtgacctcacttggtaatgccctgtctcagcatgtgtgtcttttccccatagaaagctctgttcatcccaaagccagatcatgggtactgcttccttctcgggtttcctgttgtaggtgctggggtgctgaggttctgcttggagtagagggtgagggggcccatcccaagcagaatgtttctgtagaagtgttacagcaccagaaggagcacagtggagggaagccctttagatggtacaaggacagcagtgggcagaagccatattccaatcttgggcagcttccagaagtctgtaccacacagaaactcttcgagtgcagcaactgtggaaaagccttcctgaagagctccactctccccaaccatctgagaactcactctgaagagataccatttacatgcccaacaggtggaaatttcttagaggagaaatcaatccttggtaataaaaagtttcacactggggaaataccccatgtgtgtaaggagtgtgggaaggcctttagtcactcatctaagctgaggaagcaccagaaatttcacactgaagtaagaccttatgagtgcagtcaatgtggtaaatccttcagccgaagctctgctctcattcagcactggagaattcacactggagaaaagccttacgagtgtagtgagtgtgggaaagcctttgctcacagctccactctcattgaacactggagagttcacacaaaagaaaggccttatgagtgcaatgaatgtgggaaattctttagccaaaactccattctcattaagcatcagaaagttcatactggagaaaagccttataaatgcagtgaatgtgggaaattctttagccgaaaatccagccttatttgtcactggagagttcacactggagaaaggccttacgaatgcagtgaatgtgggagagcctttagcagtaactcccacctggttcgtcatcagagagttcacacacaagaaaggccctatgagtgcatccagtgtggaaaagcctttagtgaaagatctacacttgttcggcaccagaaagttcacaccagagaaagg

SEQ ID NO: 34833 - DNA, 2242 bp, Homo sapiens
atctaccttctgagatatcatccttcttcagggagataaggaaaaaaagccacagggtcccggagagccaggggaatgttttgtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgtaa

SEQ ID NO: 34834 - DNA, 481 bp, Homo sapiens
ggcgctgtgccgaggattcggggtagtgtagtcctggcgccccgctggaggagctccccagctggtggctggagcgaccccttgttctttggtggcgctgatctaccttctgagatatcatccttcttcagggagataaggaaaaaaagccacagggtcccggagagccaggggaatggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagatcatcaagaatatggaaacaactgtgacctacagaaagaagcagatccagagccagagctctacctcgatcctttctgc

SEQ ID NO: 34835 - DNA, 2701 bp, Homo sapiens
cgccgagcatcctgggaggtgtggtccgggcgctgtgccgaggattcggggtagtgtagtcctggcgccccgctggaggagctccccagctggtggctggagcgaccccttgttctttggtggcgctgatctaccttctgagatatcatccttcttcagggagataaggaaaaaaagccacagggtcccggagagccaggggaatgcttcaaaagttctgctgcctgagagtaacgtcacagtaatggaacgggaagattctggaatctgtgtccccacctagacaacgattatactggcaggatctatcaggtgtacctattttggaactctggagtctagttgaaggcctccagttcccagggggaaggaagcatggaggtgtgtcctccatttggaagtagtgctaagaaaattaaaagaataaaactgggcaggggcatgagaataggatgcaaagatgaatttttggactgagtggccaagaagctccatggtgagcactcacagtctaaggctggaagtttaatgaactgttttctacatttcacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgtaa

SEQ ID NO: 34836 - DNA, 2318 bp, Homo sapiens
gtgccgaggattcggggtagtgtagtcctggcgccccgctggaggagctccccagctggtggctggagcgaccccttgttctttggtggcgctgatctaccttctgagatatcatccttcttcagggagataaggaaaaaaagccacagggtcccggagagccaggggaatggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatc

SEQ ID NO: 34837 - DNA, 2397 bp, Homo sapiens
gtagtgtagtcctggcgccccgctggaggagctccccagctggtggctggagcgaccccttgttctttggtggcgctgtgtgtcctccatttggaagtagtgctaagaaaattaaaagaataaaactgggcaggggcatgagaataggatgcaaagatgaatttttggactgagtggccaagaagctccatggtgagcactcacagtctaaggctggaagtttaatgaactgttttctacatttcacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctg

SEQ ID NO: 34838 - DNA, 2316 bp, Homo sapiens
attcggggtagtgtagtcctggcgccccgctggaggagctccccagctggtggctggagcgaccccttgttctttggtggcgctgttttgtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagaaaaacagcagctcttacaatgatgttgagcacattaaaaagaatgctgtacaatccaaggagcaagtcattgtggttgcccaggaagctgtcttggaaacccaaaatatatgtgtaacgggaggaagactgttctagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttc

SEQ ID NO: 34839 - DNA, 637 bp, Homo sapiens
gatgaatttttggactgagtggccaagaagctccatggtgagcactcacagtctaaggctggaagtttaatgaactgttttctacatttcacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaac

SEQ ID NO: 34840 - DNA, 523 bp, Homo sapiens
agtgtagtcctggcgccccgctggaggagctccccagctggtggctggagcgaccccttgttctttggtggcgctgttttgtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagc

SEQ ID NO: 34841 - DNA, 2064 bp, Homo sapiens
agtcctggcgccccgctggaggagctccccagctggtggctggagcgaccccttgttctttggtggcgctgaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttat

SEQ ID NO: 34842 - DNA, 1999 bp, Homo sapiens
agtgtagtcctggcgccccgctggaggagctccccagctggtggctggagcgaccccttgttctttggtggcgctgatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgt

SEQ ID NO: 34843 - DNA, 3535 bp, Homo sapiens
gctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcagatcctctgtggttgttgaattgtaacaagagagagaactctggctgcctgagagggcatgactctagtcacagcaggaggggcttggacaggccctggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatgaacaccagggtacacaccatggactgaaacttcacacatgtggggcatgtgggagacaattctggttcagtgcaaaccttcatcagtaccagaagtgttacagtatagagcaacccttaagaagggataaaagtgaggcctcaattgtgaagaactgcacagttagcaaagaacctcatccgtcagagaagccctttacgtgtaaggaggagcagaaaaacttccaggctactttgggtggctgccaacaaaaggccatccacagtaagaggaagacacacaggagcactgagagtggggatgcatttcatggtgaacaaatgcattacaagtgcagtgaatgtgggaaagctttcagccgcaaagacacacttgtccagcaccagagaattcatagtggagagaagccttatgagtgcagcgaatgtgggaaagccttcagccgcaaagctacacttgtccagcatcagagaatccatactggagaaaggccttatgaatgcagcgaatgtggaaaaaccttcagtcgaaaagacaaccttactcagcacaagagaatccacactggagaaatgccttataagtgcaatgaatgtgggaaatattttagccatcactccaatctaattgtacaccagagagttcacaatggagcaaggccttataagtgcagtgattgtgggaaagtcttcagacacaaatctacacttgttcagcatgagagtattcacactggagaaaatccttatgattgcagtgattgtgggaaatcctttggccacaaatacaccctcattaaacatcagcgaattcacactgagtcaaagccgtttgagtgcattgaatgcgggaaattctttagtcgaagttctgactatattgcacaccagagggttcacactggtgaaaggccttttgtgtgcagtaaatgtgggaaagactttatcagaacctcccaccttgttcgacaccaaagagttcacactggagaaaggccatatgagtgcagtgaatgtgggaaggcctacagcttaagctcccacctcaatcggcaccagaaagttcacactgcaggcaggctttaggagtgctttgaatacaacaggactcatcaatcagatgttgaatttcatgtatctgaacattgacacaaaggagataccttatggtgccaggtacgtgggaaccttctagggatatgttgcactttctgacttgctcaggttttttgccagagttatgtcactgtcaatccatgtggccgaaaccatcttaactctaccagctaagataccccagcattggggaaggcagggttttgtattgtccagtccctggagaaaatcatgaaatgcctgagttcattgggggtcctcattcccttctgtatgacaggtataggtatggatatgacccatttttagccaagagggtctgagctgtatctgctggtggcttatacaaaaagtttactttcttcatggatattcttggtctcacatacttgtaatcaagtttttccagcctccaagtcacctggcctgggaaagtacttgcctcatgttgctctggtttgtgataataaaggctttacagtttaagccacatttaatcttggggcttcttcttatggtctggggtggattgaaaacaggctctgccaaactgaagacagcctttgtgcggtgcctccaactttgcctcaaatgggacagtgggttgagggagaacagttcttagtccagttttgatgttaacttccatagctgacaaagcttgttaagtaagaattaagatcttgtgtagacctgatttgtctggattttagagttatttgagagcccatatttcaccttgaggagggtgctgctgctgtgacagcctgcagtgttttgaaacagcatggattgggtgtcttgtttgcagcatgtgtcccatgttccccaacactgttgagggaaagctgttcctcaggacctgctgagtggccatattccctgaaggcctgaatctgtttcacaggccactgttggtaagatctaaagcatccagtagggaaacaaaattgataaatattgagtgtgagtaattgggattggggagattgtggcaaactagaggggaagtgcccattgtaaaaacacatccacagacagtccaggcactaaggctgaatgggatcagggtatccagaaatctcaggatctccagggccatgttactgttaggtcaaggtcactggtgcagcaacgaatgtagtttttctagattcctctccctccctgggctctttacctaatgtctttgcggcacaggcggtaaccctgggagtaaagaggtgtggtccaaggaagtagcttttgtgaccagctggagtttctggtgactcttttggcaatggtcctcattgtttgccagtttttcttactactgaggaagagattgtcttcccaagatatttggagtgataagagtcaccatagtgaggtagagtcactcttagtgatgtccagttgtccagtttccaatagaagtgggagatccagatttttaaatgggataactttttataggttcactgaggtgtaatcaacatgcaatatattgcacatatttaaagtgtacgagttaagtcttgatacacacacacacacacacacacacacacacacacacacttgaaactatcaccctatcagtggtattggacatatctgttacccccaaagttaacctgaggcccttaacctttctctcagtgctcgccttcccccagaatccctaggcaaccactgagtagttttcactgtaggtaaatttgtcttttctagaattttatgtaagtctgcctataaagtgttaattttgcatgctgtctttcatgcaacataatttgaaatttgtccatggtatgtatgaacagtccattttaaaattactgagtcatattctgtatggatataccacagtttatccatttatcttaattgatgtctgtactccacccccatttttaaatattaaaaagctgctgc

SEQ ID NO: 34844 - DNA, 1676 bp, Homo sapiens
atcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcaggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatgaacaccagggtacacaccatggactgaaacttcacacatgtggggcatgtgggagacaattctggttcagtgcaaaccttcatcagtaccagaagtgttacagtatagagcaacccttaagaagggataaaagtgaggcctcaattgtgaagaactgcacagttagcaaagaacctcatccgtcagagaagccctttacgtgtaaggaggagcagaaaaacttccaggctactttgggtggctgccaacaaaaggccatccacagtaagaggaagacacacaggagcactgagagtggggatgcatttcatggtgaacaaatgcattacaagtgcagtgaatgtgggaaagctttcagccgcaaagacacacttgtccagcaccagagaattcatagtggagagaagccttatgagtgcagcgaatgtgggaaagccttcagccgcaaagctacacttgtccagcatcagagaatccatactggagaaaggccttatgaatgcagcgaatgtggaaaaaccttcagtcgaaaagacaaccttactcagcacaagagaatccacactggagaaatgccttataagtgcaatgaatgtgggaaatattttagccatcactccaatctaattgtacaccagagagttcacaatggagcaaggccttataagtgcagtgattgtgggaaagtcttcagacacaaatctacacttgttcagcatgagagtattcacactggagaaaatccttatgattgcagtgattgtgggaaatcctttggccacaaatacaccctcattaaacatcagcgaattcacactgagtcaaagccgtttgagtgcattgaatgcgggaaattctttagtcgaagttctgactatattgcacaccagagggttcacactggtgaaaggccttttgtgtgcagtaaatgtgggaaagactttatcagaacctcccaccttgttcgacaccaaagagttcacactggagaaaggccatatgagtgcagtgaatgtgggaaggcctacagcttaagctcccacctcaatcggcaccagaaagttcacactgcaggcaggctttaggagtgctttgaatacaacaggactcatcaatcagatgttgaatttcatgtatctgaacattgacacaaaggagataccttatggtgccaggtacgtgggaaccttctagggatatgttgcactttctgacttgctcaggttttttgccagagttatgtcactgtcaatccatgtggccg

SEQ ID NO: 34845 - DNA, 1769 bp, Homo sapiens
atcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcagatcctctgtggttgttgaattgtaacaagagagagaactctggctgcctgagagggcatgactctagtcacagcaggaggggcttggacaggccctggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatgaacaccagggtacacaccatggactgaaacttcacacatgtggggcatgtgggagacaattctggttcagtgccttcatcagtaccagaagtgttacagtatagagcaacccttaagaagggataaaagtgaggcctcaattgtgaagaactgcacagttagcaaagaacctcatccgtcagagaagccctttacgtgtaaggaggagcagaaaaacttccaggctactttgggtggctgccaacaaaaggccatccacagtaagaggaagacacacaggagcactgagagtggggatgcatttcatggtgaacaaatgcattacaagtgcagtgaatgtgggaaagctttcagccgcaaagacacacttgtccagcaccagagaattcatagtggagagaagccttatgagtgcagcgaatgtgggaaagccttcagccgcaaagctacacttgtccagcatcagagaatccatactggagaaaggccttatgaatgcagcgaatgtggaaaaaccttcagtcgaaaagacaaccttactcagcacaagagaatccacactggagaaatgccttataagtgcaatgaatgtgggaaatattttagccatcactccaatctaattgtacaccagagagttcacaatggagcaaggccttataagtgcagtgattgtgggaaagtcttcagacacaaatctacacttgttcagcatgagagtattcacactggagaaaatccttatgattgcagtgattgtgggaaatcctttggccacaaatacaccctcattaaacatcagcgaattcacactgagtcaaagccgtttgagtgcattgaatgcgggaaattctttagtcgaagttctgactatattgcacaccagagggttcacactggtgaaaggccttttgtgtgcagtaaatgtgggaaagactttatcagaacctcccaccttgttcgacaccaaagagttcacactggagaaaggccatatgagtgcagtgaatgtgggaaggcctacagcttaagctcccacctcaatcggcaccagaaagttcacactgcaggcaggctttaggagtgctttgaatacaacaggactcatcaatcagatgttgaatttcatgtatctgaacattgacacaaaggagataccttatggtgccaggtacgtgggaaccttctagggatatgttgcactttctgacttgctcaggttttttgccagagttatgtcactgtcaatccatgtggccg

SEQ ID NO: 34846 - DNA, 3025 bp, Homo sapiens
ggagttaggctcgcgccggcgcagtgtcggctgccggtgccgcggcctttgtctcgcagtcaggaggagcagggccagccgttcctgccagaagccagggcatgacccctggggtgcgcgtctccacagacccggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggccttcagccacagctcatccttgaccaaacaccagcgaatccacacaggggagaagccctacgagtgccatgagtgtggaaaagccttcacccagatcacaccactgattcagcaccagaggacccacacaggagaaaagccctatgagtgtggtgagtgtgggaaagccttcagtcagagcacactcctgaccgagcatcggaggattcacacaggagagaagccctatggatgcaacgagtgtgggaaaaccttcagccacagctcctcactcagccagcatgagcggacacacacaggagagaagccctatgagtgcagtcagtgtgggaaggccttccggcagagcacacacctcacccaacaccagcgaatccacacaggggagaagccctatgaatgcaatgactgcggcaaggcattcagtcacagctcgtccctcaccaaacatcagcgaatccacactggggagaagccctacgaatgcaaccagtgtggcagagccttcagccagcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccgtagagtctcactgattctgagatggcttttgctgctctgttctccctctacatttctctgcagaactcgcgttagaaacacagatatttgttttacaaaaagggagatttttcctttgttaaaccatcgtcttataagcaatagcaaattcatgttagaaa

SEQ ID NO: 34847 - DNA, 2453 bp, Homo sapiens
gaaatggagttaggctcgcgccggcgcagtgtcggctgccggtgccgcggcctttgtctcgcagtcaggagggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccgtagagtctcactgattctgagatggcttttgctgctctgttctccctctacatttctctgcagaactcgcgttagaaacacagatatttgttttacaaaaagggagatttttcctttgttaaaccatcgtcttataagcaatagcaaattcatgttagaaacttctgttttgcaagattcatcttttttgggatatgttcaagttaatcctctcaaactgctttttcattgttttcatacaatttaacattttgttaaaccctaagtccacaaatagcagtctttctgacaactataacctttaaatggtgacttgctgccctcattagaaattgcattggctggccaggcgcggtgacttatgcctgtaatcccagcactttgggaggccaaggtgggaggatcacctgaggtcgggagatggaggttgcagtgagctgagatcgtaccattgcactccagcctgggcaacaagagtgaaactctgtctc

SEQ ID NO: 34848 - DNA, 3329 bp, Homo sapiens
gaaatggagttaggctcgcgccggcgcagtgtcggctgccggtgccgcggcctttgtctcgcagtcaggagggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagagattaagggacatttccagtttttgcttctttcagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggccttcagccacagctcatccttgaccaaacaccagcgaatccacacaggggagaagccctacgagtgccatgagtgtggaaaagccttcacccagatcacaccactgattcagcaccagaggacccacacaggagaaaagccctatgagtgtggtgagtgtgggaaagccttcagtcagagcacactcctgaccgagcatcggaggattcacacaggagagaagccctatggatgcaacgagtgtgggaaaaccttcagccacagctcctcactcagccagcatgagcggacacacacaggagagaagccctatgagtgcagtcagtgtgggaaggccttccggcagagcacacacctcacccaacaccagcgaatccacacaggggagaagccctatgaatgcaatgactgcggcaaggcattcagtcacagctcgtccctcaccaaacatcagcgaatccacactggggagaagccctacgaatgcaaccagtgtggcagagccttcagccagcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccgtagagtctcactgattctgagatggcttttgctgctctgttctccctctacatttctctgcagaactcgcgttagaaacacagatatttgttttacaaaaagggagatttttcctttgttaaaccatcgtcttataagcaatagcaaattcatgttagaaacttctgttttgcaagattcatcttttttgggatatgttcaagttaatcctctcaaactgctttttcattgttttcatacaatttaacattttgttaaaccctaagtccacaaatagcagtctttctgacaactataacctttaaatggtgacttgctgccctcattagaaattgcattggctggccaggcgcggtgacttatgcctgtaatcccagcactttgggaggccaaggtgggaggatcacctgaggtcgggagatggaggttgcagtgagctgagatcgtaccattgcactccagcctgggcaacaagagtgaaactctgtctc

SEQ ID NO: 34849 - DNA, 2078 bp, Homo sapiens
gaaatggagttaggctcgcgccggcgcagtgtcggctgccggtgccgcggcctttgtctcgcagtcaggaggggccagccgttcctgccagaagccagggcatgacccctggggtgcgcgtctccacagacccggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggccttcagccacagctcatccttgaccaaacaccagcgaatccacacaggggagaagccctacgagtgccatgagtgtggaaaagccttcacccagatcacaccactgattcagcaccagaggacccacacaggagaaaagccctatgagtgtggtgagtgtgggaaagccttcagtcagagcacactcctgaccgagcatcggaggattcacacaggagagaagccctatggatgcaacgagtgtgggaaaaccttcagccacagctcctcactcagccagcatgagcggacacacacaggagagaagccctatgagtgcagtcagtgtgggaaggccttccggcagagcacacacctcacccaacaccagcgaatccacacaggggagaagccctatgaatgcaatgactgcggcaaggcattcagtcacagctcgtccctcaccaaacatcagcgaatccacactggggagaagccctacgaatgcaaccagtgtggcagagccttcagccagcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataa

SEQ ID NO: 34850 - DNA, 3349 bp, Homo sapiens
gtgccgcggcctttgtctcgcagtcaggaggagcagggccagccgttcctgccagaagccagggcatgacccctggggtgcgcgtctccacagacccggtgagaatctcggcctccttgcgcgtgtcctccacctcgtgcccggcctcctcgcgcgcggccttctcacgcccggcctcctctttgcaccccgtccctactcgcgctcagcctcctccttgtgcccggcccctacttgcgtgcccggcccctactcgtgcccggcctctactcgcacaactggcctctactcgcgcacctggcctctactggtgcccggcctctactcgtgcccggcctctatttgcacatctagcctctactcgtgtccggcctctacctgcacacccggcctcctaaagtccgcgccaagctccccaaccacagcctgcctctgaaaggaccgcccacgccgcgctggaggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggccttcagccacagctcatccttgaccaaacaccagcgaatccacacaggggagaagccctacgagtgccatgagtgtggaaaagccttcacccagatcacaccactgattcagcaccagaggacccacacaggagaaaagccctatgagtgtggtgagtgtgggaaagccttcagtcagagcacactcctgaccgagcatcggaggattcacacaggagagaagccctatggatgcaacgagtgtgggaaaaccttcagccacagctcctcactcagccagcatgagcggacacacacaggagagaagccctatgagtgcagtcagtgtgggaaggccttccggcagagcacacacctcacccaacaccagcgaatccacacaggggagaagccctatgaatgcaatgactgcggcaaggcattcagtcacagctcgtccctcaccaaacatcagcgaatccacactggggagaagccctacgaatgcaaccagtgtggcagagccttcagccagcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccgtagagtctcactgattctgagatggcttttgctgctctgttctccctctacatttctctgcagaactcgcgttagaaacacagatatttgttttacaaaaagggagatttttcctttgttaaaccatcgtcttataagcaatagcaaattcatgttag

SEQ ID NO: 34851 - DNA, 2253 bp, Homo sapiens
gtcggctgccggtgccgcggcctttgtctcgcagtcaggaggggccagccgttcctgccagaagccagggcatgacccctggggtgcgcgtctccacagacccggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagagattaagggacatttccagtttttgcttctttcagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggccttcagccacagctcatccttgaccaaacaccagcgaatccacacaggggagaagccctacgagtgccatgagtgtggaaaagccttcacccagatcacaccactgattcagcaccagaggacccacacaggagaaaagccctatgagtgtggtgagtgtgggaaagccttcagtcagagcacactcctgaccgagcatcggaggattcacacaggagagaagccctatggatgcaacgagtgtgggaaaaccttcagccacagctcctcactcagccagcatgagcggacacacacaggagagaagccctatgagtgcagtcagtgtgggaaggccttccggcagagcacacacctcacccaacaccagcgaatccacacaggggagaagccctatgaatgcaatgactgcggcaaggcattcagtcacagctcgtccctcaccaaacatcagcgaatccacactggggagaagccctacgaatgcaaccagtgtggcagagccttcagccagcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccat

SEQ ID NO: 34852 - DNA, 3324 bp, Homo sapiens
ggcgcagtgtcggctgccggtgccgcggcctttgtctcgcagtcaggagggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagagattaagggacatttccagtttttgcttctttcagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggccttcagccacagctcatccttgaccaaacaccagcgaatccacacaggggagaagccctacgagtgccatgagtgtggaaaagccttcacccagatcacaccactgattcagcaccagaggacccacacaggagaaaagccctatgagtgtggtgagtgtgggaaagccttcagtcagagcacactcctgaccgagcatcggaggattcacacaggagagaagccctatggatgcaacgagtgtgggaaaaccttcagccacagctcctcactcagccagcatgagcggacacacacaggagagaagccctatgagtgcagtcagtgtgggaaggccttccggcagagcacacacctcacccaacaccagcgaatccacacaggggagaagccctatgaatgcaatgactgcggcaaggcattcagtcacagctcgtccctcaccaaacatcagcgaatccacactggggagaagccctacgaatgcaaccagtgtggcagagccttcagccagcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccgtagagtctcactgattctgagatggcttttgctgctctgttctccctctacatttctctgcagaactcgcgttagaaacacagatatttgttttacaaaaagggagatttttcctttgttaaaccatcgtcttataagcaatagcaaattcatgttagaaacttctgttttgcaagattcatcttttttgggatatgttcaagttaatcctctcaaactgctttttcattgttttcatacaatttaacattttgttaaaccctaagtccacaaatagcagtctttctgacaactataacctttaaatggtgacttgctgccctcattagaaattgcattggctggccaggcgcggtgacttatgcctgtaatcccagcactttgggaggccaaggtgggaggatcacctgaggtcgggagatggaggttgcagtgagctgagatcgtaccattgcactccagcctgggcaacaagagtgaaactctgtctcagaaaaaaaaaaaaaaa

SEQ ID NO: 34853 - DNA, 3011 bp, Homo sapiens
tttctcgcgtctgccgtacttggtttcgcttcgctagtcccagaggcccagagtggctcgcctggagtctctgtggcgcggtttcctgtacctgccttgggatccggagggaggaagctgggacacccgggagtcaggaaatggactcggtggcttttgaggatgtagatgtgaacttcacccaggaggagtgggctttgctagatccttcccagaagaatctctacagagatgtgatgtgggaaaccatgaggaatctggcctctatagggaaaaaatggaaggaccagaacattaaagatcactacaaacaccgagggagaaatctaagaagtcatatgttagaaagactctatcaaactaaggatggtagtcagcgtggaggaatttttagccagtttgcaaatcagaatctgagcaagaaaatccctggagtgaaactctgtgaaagcattgtatatggagaagtcagcatgggtcagtcatcccttaatagacacatcaaagatcacagtggacatgaaccaaaggaatatcaggaatatggagagaagccagatacacgtaaccagtgttggaaacccttcagttctcaccactcctttcgaacacatgagataattcacactggagagaaactctatgattgtaaggaatgtggaaaaaccttcttttctctcaaaagaattagaagacacatcatcacacacagtggatatacaccatataaatgtaaggtgtgtgggaaagcttttgattatcccagtagatttcgaacacatgaaagaagtcacactggagagaaaccctatgaatgtcaggaatgtggaaaagccttcacttgtatcacaagtgttcgaagacacatgataaagcacactggagatggaccttataaatgtaaggtatgtgggaaaccctttcattctctgagttcatttcaagtgcatgaaagaattcacactggagaaaaaccctttaaatgtaagcaatgtggtaaagccttcagttgttccccaaccttacgaatacatgaaagaacccatactggagagaaaccttatgaatgcaagcagtgtgggaaggccttcagttatctcccctcccttcgactacatgaaagaattcacactggtgagaaacccttcgtatgtaaacaatgtggtaaagcctttagatctgccagtacctttcaaatacatgaaaggactcacactggagaaaaaccttatgaatgtaaggaatgtggggaagcattcagttgtatcccaagtatgcgaagacacatgataaaacatactggagaaggaccttataaatgtaaggtatgtgggaaaccctttcattctctgagtccatttcgaatacatgaaagaactcacactggagagaaaccttatgtatgtaaacattgtggtaaagctttcgtttcttcaacatcaattcgaatacatgaaagaactcatactggagagaaaccctatgagtgtaagcaatgtgggaaagccttcagttatctcaactcctttcgaacacatgaaatgattcacactggtgagaaaccctttgaatgtaagcgatgtggtaaagcctttagatcttctagttcctttcgactacatgaaaggactcacactggacagaaaccctatcattgcaaggaatgtgggaaagcctattcttgccgtgccagctttcagagacacatgttaacacatgctgaagatggaccaccttataaatgcatgtgggaaagcctttaatgctctgggttcatgtcagatacattaaaatactcactgaagagaagccctatgaatgtaagtaacgtgggaaagcatgaaattctgtcagtgccttttttaatacatgaaagaattctagagagaagccatatacatgtaagtaacatgggaaagctttcaatcattttagttcctttcaaatacatgaaagaactcatcatggagaaaaccaaacaaatgctttttggaaaggaacccatatttgagagaaaccctgggtaaagggtgtaggaaaggttttgtcatcacacaaccctgtcacacatgaatgtgtagtggagagaaccttggtaaatgtaaagagtgtgggagagcctttagtcattttagttccacttgaagccatgaaagaacacacaaaagagaaagctcttgaatataagcaatgtccacacgtttttagccagcccacatgctttcaacaacatgtaagaatgtaccctggatcaaaacactataaatgtgaaaactacaaggaaggttttccattatacttttaaagtcatttgagggctctggctctgtggctttgtgggttaaagtacttgtctggcaaacaggagatgctggatttcaatcccagcagggcctcactagttgaggtattgaatttgaacagatgttttggctctggctgggtgtggtggctcacacctgtaatcccagcactttgggaggctgaggcaggaggatcacttgaggtcaggagtttgagaccagtgtgcaaaacatagcaagacctcatctcagaaaaaaaaaaaaagtcatttgaaaacttctaatacagcaaaatcctataaatgtaagtacttcaaaaagcctcatgcatagcgggtcatgtagtctctagaaaatacataacctgatggaaatgtagaagctatatgtatattttgttaattagtggctcatatttaaaatagttctctgactatggatttcaaatgcttaatctcacaaagaaatgttaaattgatataatcctgtaagtaatctgaaagcaatagtgcatgaatttcataggtagtgttgttttaggtcagtaaataaaatatttgtctttccattttgaaatgtgtttaatccaacaatgaatttaaatgtgtttctcatattcaggtatgttaaattgtatatggttgcttaattgttctgtgattgaggaccactgaaaaataagtcttaataaatgttggtatgaaccta

SEQ ID NO: 34854 - DNA, 1920 bp, Homo sapiens
aggcccagagtggctcgcctggagtctctgtggcgcggtttcctgtacctgccttgggatccggagggaggaagctgggacacccgggagtcaggaaatgggaaaaaatggaaggaccagaacattaaagatcactacaaacaccgagggagaaatctaagaagtcatatgttagaaagactctatcaaactaaggatggtagtcagcgtggaggaatttttagccagtttgcaaatcagaatctgagcaagaaaatccctggagtgaaactctgtgaaagcattgtatatggagaagtcagcatgggtcagtcatcccttaatagacacatcaaagatcacagtggacatgaaccaaaggaatatcaggaatatggagagaagccagatacacgtaaccagtgttggaaacccttcagttctcaccactcctttcgaacacatgagataattcacactggagagaaactctatgattgtaaggaatgtggaaaaaccttcttttctctcaaaagaattagaagacacatcatcacacacagtggatatacaccatataaatgtaaggtgtgtgggaaagcttttgattatcccagtagatttcgaacacatgaaagaagtcacactggagagaaaccctatgaatgtcaggaatgtggaaaagccttcacttgtatcacaagtgttcgaagacacatgataaagcacactggagatggaccttataaatgtaaggtatgtgggaaaccctttcattctctgagttcatttcaagtgcatgaaagaattcacactggagaaaaaccctttaaatgtaagcaatgtggtaaagccttcagttgttccccaaccttacgaatacatgaaagaacccatactggagagaaaccttatgaatgcaagcagtgtgggaaggccttcagttatctcccctcccttcgactacatgaaagaattcacactggtgagaaacccttcgtatgtaaacaatgtggtaaagcctttagatctgccagtacctttcaaatacatgaaaggactcacactggagaaaaaccttatgaatgtaaggaatgtggggaagcattcagttgtatcccaagtatgcgaagacacatgataaaacatactggagaaggaccttataaatgtaaggtatgtgggaaaccctttcattctctgagtccatttcgaatacatgaaagaactcacactggagagaaaccttatgtatgtaaacattgtggtaaagctttcgtttcttcaacatcaattcgaatacatgaaagaactcatactggagagaaaccctatgagtgtaagcaatgtgggaaagccttcagttatctcaactcctttcgaacacatgaaatgattcacactggtgagaaaccctttgaatgtaagcgatgtggtaaagcctttagatcttctagttcctttcgactacatgaaaggactcacactggacagaaaccctatcattgcaaggaatgtgggaaagcctattcttgccgtgccagctttcagagacacatgttaacacatgctgaagatggaccaccttataaatgcatgtgggaaagcctttaatgctctgggttcatgtcagatacattaaaatactcactgaagagaagccctatgaatgtaagtaacgtgggaaagcatgaaattctgtcagtgccttttttaatacatgaaagaattctagagagaagccatatacatgtaagtaacatgggaaagctttcaatcattttagttcctttcaaatacatgaaagaactcatcatggagaaaaccaaacaaatgctttttggaaaggaacccatatttgagagaaaccctgggtaaagggtgtaggaaaggttttgtcatcacacaaccctgtcacacatgaatgtgtagtggagagaa

SEQ ID NO: 34855 - DNA, 1141 bp, Homo sapiens
ggagcggacatgacgtcttccgggaggcggcggggtctttgtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatgggaccactgacatttatggatgtggccatagagttctctttggaggagtggcagtgcctggacactgcacagcggaatgtatataggcatgtgatgttagagaactacagaaacctggttttcttggacctgattacctgtctggaacaaggaaaagagccctggaatatgaagagacatgagatggtggtagccaaacattcagctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaa

SEQ ID NO: 34856 - DNA, 2582 bp, Homo sapiens
ggacatgacgtcttccgggaggcggcggggtctttgtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatgggaccactgacatttatggatgtggccatagagttctctttggaggagtggcagtgcctggacactgcacagcggaatgtatataggcatgtgatgttagagaactacagaaacctggttttcttggacctgattacctgtctggaacaaggaaaagagccctggaatatgaagagacatgagatggtggtagccaaacattcagctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaacaacttactgaacataagaaaatttacactagagagaaagcctacaaatgtgaagaatgtggcaaagcctttaaccagttttcaacccttattacacataagataattcatagcggagagaaaccccacaaatgtgaagaatgtggcagagcttttaaccagtccgcaaagctcactgaacataagttaattcatactggagaaaaaccctacaaatgtaaagaatgtggaaaagcttttcaccgatactcaatccttagtacacataagaaaattcatactggggagaaaccccacaaatgtggagaatgcggaaaagcctttaactggtcctcaactcttattacacataagataattcacagtggagaaaaaccctacaaatgtgaagaatgtggcaaagcttttaaccagtcctcacaccttatgagacataagaaaattcatagtaaagagaaaccctacaaatgtgaacagtgtggcaaggtctttaagaagtcctcaactcttactgcacataagatcattcatactggagagaaaccttacaaatgtgaggaatgtggcaaaggttttagccaactctcaaaccttactaaacacaagaagattcatactagagagaaaccctacaaatgtgaagaatgtggcatatcttttaaccagttctcacaacttgctatacataagatgattcacacttgaatgaaaccctacaaatgtgaacgatgtggcagttgttttaactagttctcgaactttactatgcataagaaaattcaaactggagagaaactctacaaatgtgaagaatgtggcaaagcttttaaccaagtctcaacacttactatacataagataatttatactggagcaaaaccttggaaattcaaagaatgtggtaaaacttacaatcctcaaaacttcttacacctaaaattcatgcaggagagaaacaccacaaatgtgaaaaatttggtaaattctttaacaagtcttcaaccctttctgcacataatataattcatactggagagaaaccccacaaatatgaagaatgtggtaatgcttttaaccaattctcaaatcttactaaacaaaattaatactgaaaatgttacaaaccagaaaaatgtgaaaatgattttaacaaaaccttcaaatttttctaaacataaaggaaatcatactggtaagaaattataaaaatgtgaagaatgtgacaaagcctttaaatggttgtcacacttgattgtaggtaagataattcatactggcagaaactcccagaagtgtgaagaatatggcaaaactttaattcctataccttattgcacaggaaagcatttatacttcagaaaatgttgtactgatataaagaatgtagaaaagccattaatatgtgcttacatcttattcaacattagagagttagtacttaataaa

SEQ ID NO: 34857 - DNA, 2235 bp, Homo sapiens
atgaagagacatgagatggtggtagccaaacattcagctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaacaacttactgaacataagaaaatttacactagagagaaagcctacaaatgtgaagaatgtggcaaagcctttaaccagttttcaacccttattacacataagataattcatagcggagagaaaccccacaaatgtgaagaatgtggcagagcttttaaccagtccgcaaagctcactgaacataagttaattcatactggagaaaaaccctacaaatgtaaagaatgtggaaaagcttttcaccgatactcaatccttagtacacataagaaaattcatactggggagaaaccccacaaatgtggagaatgcggaaaagcctttaactggtcctcaactcttattacacataagataattcacagtggagaaaaaccctacaaatgtgaagaatgtggcaaagcttttaaccagtcctcacaccttatgagacataagaaaattcatagtaaagagaaaccctacaaatgtgaacagtgtggcaaggtctttaagaagtcctcaactcttactgcacataagatcattcatactggagagaaaccttacaaatgtgaggaatgtggcaaaggttttagccaactctcaaaccttactaaacacaagaagattcatactagagagaaaccctacaaatgtgaagaatgtggcatatcttttaaccagttctcacaacttgctatacataagatgattcacacttgaatgaaaccctacaaatgtgaacgatgtggcagttgttttaactagttctcgaactttactatgcataagaaaattcaaactggagagaaactctacaaatgtgaagaatgtggcaaagcttttaaccaagtctcaacacttactatacataagataatttatactggagcaaaaccttggaaattcaaagaatgtggtaaaacttacaatcctcaaaacttcttacacctaaaattcatgcaggagagaaacaccacaaatgtgaaaaatttggtaaattctttaacaagtcttcaaccctttctgcacataatataattcatactggagagaaaccccacaaatatgaagaatgtggtaatgcttttaaccaattctcaaatcttactaaacaaaattaatactgaaaatgttacaaaccagaaaaatgtgaaaatgattttaacaaaaccttcaaatttttctaaacataaaggaaatcatactggtaagaaattataaaaatgtgaagaatgtgacaaagcctttaaatggttgtcacacttgattgtaggtaagataattcatactggcagaaactcccagaagtgtgaagaatatggcaaaactttaattcctataccttattgcacaggaaagcatttatacttcagaaaatgttgtactgatataaagaatgtagaaaagccattaatatgtgcttacatcttattcaacattagagagttagtacttaataaa

SEQ ID NO: 34858 - DNA, 2574 bp, Homo sapiens
gtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatggccagaaaaactgggaaaatcacaggctcttccacttactggatatttaacaagatattcttcttgagccaaaaacattgacattagcgggaccactgacatttatggatgtggccatagagttctctttggaggagtggcagtgcctggacactgcacagcggaatgtatataggcatgtgatgttagagaactacagaaacctggttttcttggctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaacaacttactgaacataagaaaatttacactagagagaaagcctacaaatgtgaagaatgtggcaaagcctttaaccagttttcaacccttattacacataagataattcatagcggagagaaaccccacaaatgtgaagaatgtggcagagcttttaaccagtccgcaaagctcactgaacataagttaattcatactggagaaaaaccctacaaatgtaaagaatgtggaaaagcttttcaccgatactcaatccttagtacacataagaaaattcatactggggagaaaccccacaaatgtggagaatgcggaaaagcctttaactggtcctcaactcttattacacataagataattcacagtggagaaaaaccctacaaatgtgaagaatgtggcaaagcttttaaccagtcctcacaccttatgagacataagaaaattcatagtaaagagaaaccctacaaatgtgaacagtgtggcaaggtctttaagaagtcctcaactcttactgcacataagatcattcatactggagagaaaccttacaaatgtgaggaatgtggcaaaggttttagccaactctcaaaccttactaaacacaagaagattcatactagagagaaaccctacaaatgtgaagaatgtggcatatcttttaaccagttctcacaacttgctatacataagatgattcacacttgaatgaaaccctacaaatgtgaacgatgtggcagttgttttaactagttctcgaactttactatgcataagaaaattcaaactggagagaaactctacaaatgtgaagaatgtggcaaagcttttaaccaagtctcaacacttactatacataagataatttatactggagcaaaaccttggaaattcaaagaatgtggtaaaacttacaatcctcaaaacttcttacacctaaaattcatgcaggagagaaacaccacaaatgtgaaaaatttggtaaattctttaacaagtcttcaaccctttctgcacataatataattcatactggagagaaaccccacaaatatgaagaatgtggtaatgcttttaaccaattctcaaatcttactaaacaaaattaatactgaaaatgttacaaaccagaaaaatgtgaaaatgattttaacaaaaccttcaaatttttctaaacataaaggaaatcatactggtaagaaattataaaaatgtgaagaatgtgacaaagcctttaaatggttgtcacacttgattgtaggtaagataattcatactggcagaaactcccagaagtgtgaagaatatggcaaaactttaattcctataccttattgcacaggaaagcatttatacttcagaaaatgttgtactgatataaagaatgtagaaaagccattaatatgtgcttacatcttattcaacattagagagttagtacttaataaaagcattataaatgcaa

SEQ ID NO: 34859 - DNA, 1066 bp, Homo sapiens
tttgtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatgggaccactgacatttatggatgtggccatagagttctctttggaggagtggcagtgcctggacactgcacagcggaatgtatataggcatgtgatgttagagaactacagaaacctggttttcttggctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaacaacttactgaacataagaaaatttacactagagagaaag

SEQ ID NO: 34860 - DNA, 842 bp, Homo sapiens
tttgtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatgggaccactgacatttatggatgtggccatagagttctctttggaggagtggcagtgcctggacactgcacagcggaatgtatataggcatgtgatgttagagaactacagaaacctggttttcttggacctgattacctgtctggaacaaggaaaagagccctggaatatgaagagacatgagatggtggtagccaaacattcagctgtagcatttacctttgatctcagtggactcaacattttgtcattccaaagtatcctgccatttgtttcagcactttatgtcatgggaaacagaaaccagtgtctgcaaaagcacctagaagccagaaataaagatctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaa

SEQ ID NO: 34861 - DNA, 2962 bp, Homo sapiens
agtgcggacgtcgccattcctggcccatgggaagattgcgtttcacctgctcctgaaggccgaaggtggctctagcgcatcctttgtcgcgccgtgacctgcaggtactgacagatccgtagggaggacaccgtgacttcccggacgctgggaaatggactcagtctcctttgaggatgtggccgtgaacttcaccctggaggagtgggctttgctggattcttcacagaaaaagctctatgaagatgtgatgcaggagaccttcaaaaacctggtttgtctaggaaaaaagtgggaagaccaggacattgaagatgaccacagaaaccaggggaaaaatcgaagatgtcatatggttgagagactctgtgaaagtagaagaggtagcaaatgtggagaaaccactagccagatgccaaatgttaatatcaacaaggaaacttttactggagcaaaaccacatgaatgcagcttttgtggaagagacttcattcatcattcgtcccttaataggcacatgagatctcacactggacagaaaccaaatgagtatcaggaatatgaaaagcaaccatgtaaatgtaaagcagttgggaaaaccttcagttatcaccactgctttcgcaaacatgaaagaactcacactggagtgaagccctatgaatgtaaacagtgtgggaaagcctttatatattaccagccatttcaaagacatgaaaggactcatgctggacagaaaccctatgaatgtaagcaatgtggaaaaacctttatatattaccagtcttttcaaaaacatgctcatactggaaagaaaccctatgaatgtaaacagtgtgggaaagcctttatatgttaccaatcttttcaaagacacaaaaggactcacactggagagaaaccctatgaatgtaagcaatgtggtaaggctttcagttgtcccacatactttcgaactcatgaaagaactcacactggagaaaaaccctacaaatgtaaagaatgtggtaaagccttcagttttctcagttcttttcgaaggcataaaaggactcatagtggagagaaaccctatgaatgtaaagaatgtggaaaagccttcttttattctgcaagctttcgagcacatgtaataatacacactggggctcgaccttataaatgtaaagaatgtgggaaagccttcaactcttctaattcctgtcgagtgcatgaaagaactcatattggagaaaaaccatatgaatgtaaacgatgtggcaaatcattcagttggtccatttctcttcgattgcatgaaagaactcatactggagagaaaccttatgagtgtaaacagtgtcataaaaccttcagtttttcaagttcccttcgagaacacgaaacaactcacactggagagaaaccctatgaatgtaaacaatgtggtaaaaccttcagtttttcaagttcccttcaaagacatgaaaggactcacaatgcagagaaaccctatgaatgtaaacagtgtgggaaagccttcaggtgttcaagttattttcgaattcatgaaaggtcacacactggagagaaaccctatgaatgtaaacagtgtggaaaagttttcattcgttccagttcctttcgactgcatgaaagaacacacactggagagaaaccctatgaatgtaaactatgcggtaaaaccttcagtttttcaagttcccttcgagaacatgaaaaaattcacactggaaataagccttttgagtgtaagcaatgtggtaaggccttccttcgttccagtcaaattcgattgcatgaaaggactcacactggagagaaaccgtatcaatgtaaacaatgtggaaaagccttcatttcttccagtaaatttcgaatgcatgagagaactcacacgggagagaaaccctatcgatgtaaacaatgtgggaaagccttcagattttcaagttctgttcgaattcatgaaaggtctcacactggagagaaaccttatgaatgcaaacaatgtggaaaagccttcatttcttccagtcactttcgactgcatgaaaggactcatatgggagagaaagtctaagaatataagcaacattctgaagccttcggttgttccagctccttctgaatacacaaaagagttcatactggacagaagctgtgtgaatacaaacattgttctaaagcccttaattgttccagtttcttttgagcacgaaagaattcccactggtgagaaacagtatgaatgtaaacattgtgattaagccttcagttgacctaattcatttcaaagacaggactcgtgctgcagtgaaatctgttttgttttttgttttttgtttttttaaaaaaggccaagcttgttggctcatgcctatagtcccagcactttgggaggccaaggtgcaaggcaggcagatcatttgaggtcagaaattcgagaccagcgtggtcaacatggtgtaaccccatctctactaaaaattaccaaaaaatgaaccaggcatggtagtgcatgcctctaatcccagctactcaggaggctaaggcaggagaatcacttgaacctggagacagaggttgcagtgagctgagatcacgccactgcattccagcctgtgcgacagaatgagacactgtctcaagaaaaaataaaagtgggaaaatcttccaactgtcctctagagtgtgaatatatgaaaggagtcagagtggggtgaaagtctataaatgtaagacatttgggaaagccttcacacagccttttgagcacacatgagaatgtatactggagagaaaccctataaatattaagaatgtgggaaattcttcatcctagttcttttgttgttgttgatgatacaaaaatattttcatttaataaagattgtcaggttatatttaataagaaagaaagtatcatgtaaacagcccagtaataaaattttacaatctt

SEQ ID NO: 34862 - DNA, 3550 bp, Homo sapiens
tatggattagccattctttattcctttactttcctaataaacttgctttcaccttatggattcgcctcaaattctttcttgtgcaagatccaagaaccctctcttagagtctgagatccggacccctttccagtagcaaaaggtcttagactgaagtactgactccacagtcgttgttaagaatcctagttgtttaatagaggcggtcttgggctcttgctgggccgcggtgtgttctgggaagtgtagtcacctgagtctccagttccttgtctctgggccgtgtgtgcacgccagcgaagcactgtgggagtcgtagtaggggaggaaaaccctataccctctggcgtgcggcgcaggagtttgggggaatgtagtcgccagagctctgcgttgtcttccggctttgggcgtggccacgatgcactctgggagtcgtagtaggggaagaacgtcctccgctcttttgcgcacggtcgctagaggttctgggaagtgtagttgcctgaagctcgtgttctttgtctttcgatgatgtgcgcttggcctcaaagcaccctgggagttgcagtggggcggggaaagccatatgctctctcgcgcggggtcgcggttgtttctgggaagtgtggtggcctgagttccacgttcttcgtttctccgctagttgtgcgcttggccgcgagacactctggcagttataggaacacaaaggtctgtgtactcttccgcggggggccgcggttatttctgggaaatgtagttgcctaggacccgggttctttgtttctcggctctgggcgtgggaggatagcccctatgctctggcgcaccgggccgcgatggctctgggaattgtagttgtcgcaggccctcgttctttgtctcctggcgttctgggcacggcagcgaggcgctctgggagttccagtaggaacgaaaagcccttgcgcgcagggccgcattggtttctgggaattgtagtttcttgaggccggcggcctggttggggtgacgtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaaagcatggacaagggatgagctttacaaagatgatgcactttggagatcagaaaattcatatttaagcaaagtgatacaaacacagtgatttgggaatgccttcatttacaatgcaatacttacattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacataacaaagtgt

SEQ ID NO: 34863 - DNA, 726 bp, Homo sapiens
ctgagttccacgttcttcgtttctccgctagttgtgcgcttggccgcgagacactctggcagttataggaacacaaagtttcttgaggccggcggcctggttggggtgacgtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagtt

SEQ ID NO: 34864 - DNA, 681 bp, Homo sapiens
actcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacact

SEQ ID NO: 34865 - DNA, 2340 bp, Homo sapiens
ctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaaagcatggacaagggatgagctttacaaagatgatgcactttggagatcagaaaattcatatttaagcaaagtgatacaaacacagtgatttgggaatgccttcatttacaatgcaatacttacattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacat

SEQ ID NO: 34866 - DNA, 2970 bp, Homo sapiens
cagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatggaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataaggtaattcatgctggagagaaaccctacacttgtgaagaatgtggcaaagcctttaaatggtctttaatatttaatgaacataagagaattcatactggagagaaaccttttacttgtgaagaatgtggcagcatctttaccacatcctcacactttgctaagcataaaataattcatactggagaaaaaccctataaatgtgaagaatgtggcaaagcctttaataggttcacaacccttactaaacataagagaattcatgctggagagaaacccatcacatgtgaagaatgtaggaaaatctttacctcatcctcaaactttgccaaacataagcgaattcatactggagagaaaccctacaaatgtgaagaatgtggcaaagcctttaataggtccacaacccttactaaacataagagaattcatactggagagaaaccctacacatgtgaagaatgtggcaaagcttttagacagtcctcaaaactgaatgaacataagaaagttcatactggagagcggccctacaaatgtgatgaatgtggcaaagcctttggacggtccagggtcctgaatgaacataaaaaaattcatactggagagaaaccctacaaatgtgaagaatgtggcaaagcctttagacggtccacagatcggagtcaacataagaaaattcatagtgcagataaaccctacaaatgtaaagaatgtgacaaagcctttaaacaattttcgctcctgagtcaacataagaaaattcatactgtagataaaccctacaaatgtaaagattgtgacaaagcctttaaacggttctcacacctgaataaacataagaaaattcatacttgagagaaatcctacaaatgtaaagaatgtggcaaacctttggatgatccacaaaccttaatgaacatgagaaaatttatactgtagagaaaccctggaaatgtgaagaacgtggcaaagttctttacctcattctcaaaccttgataaacataagagaattcataccggagagaaactgtacaaatgtgaagaatatggcaaagcctgtgaatggtccacaaacctgaatgagcagaagaaaattattactggagataaaccctgcaaatgtaaagagtgtaacaaaacctttaaacagccctcaccggtgaataaacataagaaaaatcatgctggagggaagccctacacatgtggcagaatgtggcaaagcatttaattggtcctcaatgcttaataaatataattcatgctggagagaaacttcacatgtgaaccgtgtggcaaagcctttaaatggtcctcaacccttaatgaacgtaagtgaattcatgctggagcaaaatgcttcacatgcgaagaatgtggcacagtctttaccacatcctcaaactttgttaaacataagagaatttataccagagagaaaccctacacatgtaaagaatgtggcaaagccttcaataggttctcaacccttactgtgcacaagataattcattctggggaaaaaaatgctacaaatgtgaaaaacgtggcagagccttcagaccatccacaaacctttatgaaaattcatatttgagagtagaagattcattccacaaacttacattgagaagatatgaaagatgaatataagaattcatcctagatataaaaccatagaaatgtaaaagatgtgacaaaacctttaagccatactccaggcttcttaaacataatgagaactcatactggaggaaagtcttacaaatgtgaagaatgtggcagtctttaaatcttcctcagtcttttctaatcataagataattcacactgaagagaaactgcaaacgtggaaagtgtgacaaagcttgcaaccacactcaatctattctaaatataagagaaatgatattggtgagaagccacaaaaatatgaaaaatgtggcaaagccttcaaatgcttgtcacatcttactgtatatatataattcctactgaagaaatcccctggaaatgcaaaaaatgtggcaggatttttaccaatgctcatctttttgcacatgatatcctttatattcgagaaaagttatagaaatataaaaaatatagaaaagtcatatctcctcacattttactaactagcaatgttcatacttaataaaaacattataaatgtaatttctgttgaaagacttcagaaaatataggcctttaaagtgaagaagagtattcttaagacaaacaataca

SEQ ID NO: 34867 - DNA, 1611 bp, Homo sapiens
gcgtctggctactaccagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatggaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataagaattcttccatctctatgacaacaagcccattttagctttctggagaatagcatctgagaaaagccaaagtgcctcagtttacagacagctcactcacagaagcagagccacctaattcaccagcatctaaccactcacacctgaaggagccaaactgagcccagaagaatggcccggctgagcccagcctaaatttctaaccagctcaatcctgagctagtatgtttcgggattgttatgcagttataagttagtaatatatacacccattaaagacaggatctcaggacagattgatcacaaataacctgcaaatgcttgccaccctgtaagtattgattttcttttttcctttatttaaagttagatttgttgtaagatgatattgagttacacagaagttaggcaggagaatagggtttggaggcagggaacttaaggccaattcgtgctgacttcctacaagaaaaaacaccaaggtctgggagcagggaacctaaagccagttaacgtgaacttcctacatctaaaccaaaaggaaagacctcatctacacccgagtagcaaaggatcgaaggcgactgtcgctacaaccctcccccttgtaccagttctctgatagaaaaggacagtgccttggagtggccgtgggccaagcacaggccatgccttcatctgcatagggtaccaattcgcctcaacctttgattagccaaggaccaaatccttcattcagataaggggtagctgataggaacctcaaaaggagtacttaaaacccagaaaacattgtaaccgggtccttgggcggcttgctggggctcacacccaccctgtagagtgctttctcactttaataaaatcttgcttttgcta

SEQ ID NO: 34868 - DNA, 6034 bp, Homo sapiens
gacaaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggaggtgagtgagcggctgcggggcggaactgggaagggaatgcgggtggagcgagctggaggcaaagtttttcgagccccgggatcagggtgggcctgggcgctgggaactctcggaaggaggtactgaagggagcacccagacgagctgggccccggcgctgcagtcgcgtcacggttctggaccccgcccgggtacctgctgctctcaggacaaaatcatgacgatgctccatcccaagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgataatattcagcttgtcagcatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgagtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggact

SEQ ID NO: 34869 - DNA, 813 bp, Homo sapiens
acaaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggaggtgagtgagcggctgcggggcggaactgggaagggaatgcgggtggagcgagctggaggcaaagtttttcgagccccgggatcagggtgggcctgggcgctgggaactctcggaaggaggtactgaagggagcacccagacgagctgggccccggcgctgcagtcgcgtcacggttctggaccccgcccgggtacctgctgctctcaggacaaaatcatgacgatgctccatcccaagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgataatattcacatttaagaagccaaaacacacaagtcggtggtgatgacagacccccttttggactcacagccagccagtagcaccg

SEQ ID NO: 34870 - DNA, 5909 bp, Homo sapiens
ccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgataatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgagtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataacgttgatttcttattgctgtacattgcgtttttaacctgcaagttctcagtttcttcaccatcactccatcaaagtccctggctataagatctggattttacccactccatcttctctttccttcttactgtgtcaattcctattttctttcagaatcttctaaaaacagttgtatctaaccgcatgtgctgttgtgcctaatgctctataaagcatgttaaacagaaa

SEQ ID NO: 34871 - DNA, 373 bp, Homo sapiens
atcctagaggcggctgagccggaggcggtcgcacaaagcgggccccgggggccgttccagccgcggccgaccatagagatgcggctcccgccggctctgggtctggagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgcatttaagaagccaaaacacacaagtcggtggtgatgacagacccccttttggactcacagccagccagtagcaccggggagatggatggactgtgccctgagctattgctgat

SEQ ID NO: 34872 - DNA, 1954 bp, Homo sapiens
gcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaaggggaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaagga

SEQ ID NO: 34873 - DNA, 2947 bp, Homo sapiens
gggcgggcctcagacacactatgcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaaggggaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttccccagttagtagagtgtctgcggtttttgttctactatatgcttgtccatttttatttgtatctcatggtttgcagactgtttgaataatttatagtttcccatccctgttaaaaaccagctcttcaagctgaaatgctaattatattggcattacattgaattatgtacaaaattataaaatttggttatttaaaattaaaaagttaaatccagtggttttgttaaagattttgcttagtattcaatttttattactgttttttaaaaataatgaatcatcaaagtttaaccacaggctggtgcccgggataacagtactgtaattggaaatggctttactctgaaaattaggttagtgggttggtgtaaattatttatttttgcttatgtacttttgttttaaagcttatttaccccaaagtttattattaattttgaatacagcaatttttaaaatgtta

SEQ ID NO: 34874 - DNA, 554 bp, Homo sapiens
gttggaaaattttctcggagaaacgtggcatggctgcattgaactgtgcctctactacatggttttatttttaaaataaaaaaccactccaccctcatagcatagttccatttctggaaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtagggacagtttgcgtctagaggatggtcaagcagtacagttagaagatggtaccacagcatttattcaccacacctccaaagatagttatgaccagagtgcattacaggcggttcagctggaagatggtaccacagctt

SEQ ID NO: 34875 - DNA, 551 bp, Homo sapiens
aaaaaaaggttactgaggtctaacatcggatattagaaatttacaattttatcctcccttttctccagttttggccaaaagagtgaacaaattcttataagtctctttgaaacgtattattgtggaacgcgaactagtttttattccttccccttttgctttggacatttgttttttccacataataacgaagttaaaaagaggaaagaagaataccattgccagcccattatttgtttaaaatcagcgtcagcctttgctttggaagtgtctaaatcagctgatataatcaagtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttc

SEQ ID NO: 34876 - DNA, 265 bp, Homo sapiens
cagaagatacttgtgttttcctgtagttgacaaaaaacggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcata

SEQ ID NO: 34877 - DNA, 644 bp, Homo sapiens
ggccggacggctgtttcctgtcctggtgcatggtggtcggacgaaggaattgttggaaaattttctcggagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaag

SEQ ID NO: 34878 - DNA, 555 bp, Homo sapiens
accgcatggcgatgcccgggagactggagaagctcaggcaggcttggaagccaatccccggcatacagcagctctcgggaatgcagagccctagagcaagaccaagggcctcggccgacactgagagcctccagggagaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcag

SEQ ID NO: 34879 - DNA, 575 bp, Homo sapiens
cctggtgcatggtggtcggacgaaggaattgttggaaaattttctcggagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctaca

SEQ ID NO: 34880 - DNA, 3854 bp, Homo sapiens
aggactcccagacccctcaccttctgcctcccctggtcgcgtccgggtccttgcggagctaactagctcgccacgacgtcaagaacgacgtaacgtcaggccgctgtgggctctgggaattgtagtccagagctagatcggccacggacagaatggcgttctcttatctctgagtcggggcctggctcgttttgacatttttgcgcccacgagtcttcggagagggcgtcgccactccagaccttccagcaagcttgaagtcatctgacgctaaaggactacttacctcaagagctccatcgtcacagaaggaggcggccaagttcgcggggggaggggaggagacagagagtcgaccagtaaagcctcaagggaaatgtagtccaaggcctgagaagcgacgttgctggtaatagaaggtaattcagtaccagcctgggcctggccgcggtgaccgaggcgggccgcgtcgcggagacttctgggagtgcttcctcgctctccgagtgcgcaagcgcagcgcaccgagtggacattttggtctttgtccgcgggtcagtacggcccctgggtccacgtggcgcgaaagtaggaggaagacataggccaaggagccagacttcctgtgttaactccttcctctgccactttttaccttggggacctcagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagagaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatcc

SEQ ID NO: 34881 - DNA, 3780 bp, Homo sapiens
aggactcccagacccctcaccttctgcctcccctggtcgcgtccgggtccttgcggagctaactagctcgccacgacgtcaagaacgacgtaacgtcaggccgctgtgggctctgggaattgtagtccagagctagatcggccacggacagaatggcgttctcttatctctgagtcggggcctggctcgttttgacatttttgcgcccacgagtcttcggagagggcgtcgccactccagaccttccagcaagcttgaagtcatctgacgctaaaggactacttacctcaagagctccatcgtcacagaaggaggcggccaagttcgcggggggaggggaggagacagagagtcgaccagtaaagcctcaagggaaatgtagtccaaggcctgagaagcgacgttgctggtaatagaaggtaattcagtaccagcctgggcctggccgcggtgaccgaggcgggccgcgtcgcggagacttctgggagtgcttcctcgctctccgagtgcgcaagcgcagcgcaccgagtggacattttggtctttgtccgcgggtcagtacggcccctgggtccacgtggcgcgaaagtaggagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagagaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatcc

SEQ ID NO: 34882 - DNA, 9651 bp, Homo sapiens
ggcgaccgcggcggcgctctagctgcggcatgtctgcgtctctactgctctgggaggaggaagagaaggaggaagaggaggaggaggaggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccgtcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaagactttcgcacaattgtttcctaactgataacattgtacattcttaggagattagtaattgtgtgaaatttactcatactgtttctaagtttttcagcatagtcattgcacttcagcagggaatctgagtatactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttggaactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttataccatgaatgtttttttttaatactctgtcttaaaataatacagcatggtacaataaatagtgcttttatgtatatatacacacacacacttttctgaagaatgatggtttgagttatgcgttgggcagttttgatttttggaagttatattagttattgactctttgttacaactttttcatttttacattttaaattttctgccatcgttgtcacaatgcacatcctgatatagcaccagtgaaaatctaaaattaatacccttggaaaatgaaaatattcttaatttccattttgactcttatactggccctatagctctgcagtctttgtttcaatatagaatatgttatccatttaaattattttttcttttatttaatgttatcccaagactgttctcataaagaaagggaagaaataactatccacccttaacatccttcatttattttgaatatattggtgtttttatgataaggaatataaattatatttaatgtggtttcctgtatactttggttattaagttttgcttgaaatagtagttttcccgtttgacagctttctttgctgccaaagttttcaagaatttaagacttctttgaagtaaatatttaagttctgccattattgactcttaagattgtgtgtgttgtgttgtgcattacataattacaaaaaggcttcattcaggtgatacgttaaaaatggaactgtgctcaccctaaataggcattggtatttttctcttttggtgagagtaggcatttatttcttgagttgttttggagcctgatcaaaaattttgttcatggagaacttgatgcaattttgatacagtggagaggtttttttcggttgttttaacatcaccagcatagtttttagaatgtgactcttgctgagcatttagggtgagcttgggaaggaaggcctttgaaaatggtagttatgcaagcagactttcaggtgttgcattcctgttttcaacacatttctttaaatctacataatggcagacttttctaccaggttataagcagtttttagataagtgatactcagccagcataacttattgacttaccatttacgtatagtcatcactctcttactgtgaaattccaaatgcctaccagagttaccttgttctatcataatatgacaaacatctcaacagttttggatttccccactttggttcagaaggttatttaatttctatctgggcattaatggagaaaataagtagccttgtgtgctgcttcagattgaaacatggaggatatgagatattcttctgcaattcatgtttctcatttctcaaagtgagcacattgttctataaaaacatgctggtacacccttaaacttttgatcaatctgagtgaggtgtgcttttcctcttgggacctactcacgtttgaagattggaaacatcacgttaggcgaggcagtatctcttgaacatcttctaaagggttttttaaaaccttattctcacatatttcatttgtcttgaatatttaagtggctcttaaacgttttgggtctacatgcaaatgtggtacttaacaaggtaggaatccatcttcttagctctggctgagggtgccagccatcggtcaggtcatttttatctcaagaggcagaaggcagttatgtcaagaattgtgctcagggcaggatttcgtttccacagaggagagacacttgcagagtgccagctaggttagatcttttgccgcttctttcatttgattaatttgggtttttaaagggctgtttaaaaaaaaaaaaaaaaggccgggaaactttaaaagtaggcattactgtagtactgcatttcttagaacattttaaactagaactcatttttttttcacagtatatttacttgaagaagcactataataatcattgagaagtattttgagtctgaaatttaatttaattttccgtttcaaattgctttatttcagggaaataattttccagttgttttgctatattctgcaaataaaaaccgtgtttccttttttcacttaaactttggtaggaaacaaactaaagcagacaaacatttcttgttatgtttgttgctttctttaatccaatggataaaaaagtaaaaccctgtaaacattattttatttttttatgcaataccatgctgtaaatatggttcatcaaataaggatgtacctatgattgaatctttaattctgcacagttagagtttatatataaacgtgtcttgacaatcaaggacttttatgtgagtcttcctttatgatgtttattaatgttatgcattccatttgttttgaagtgagtaccaatgtgctaatttgtattgtctgaaagtatgtaatgtttttacagcttgtttttaagaatctgtaaatatgtacaaacaaatcacagtactgctttatgttagaaggcatatgatgttgtactgtatgtaagcaataatacatagcagtgctaactttacaagtagcatcaggaaagttctaaaaacatttcagagttattaattatccttatttcatttaataatgattatctttaatcagtttttataagcaaattccattgttcctcctattggaacgtaacactgtttacacagcataattgaagttgcaggggagacaggctaaatctgacttcatctgtactcactttcactaagcattgaatggccttaccactcttctgcaagatggaggaagaccgcaaaacttagtgcccatcacactgaaggaagggatgtggttttttttcctgcttctgtactgctacctaactttgtgatttgctttggattttaatatttgtttctgttttagattcaagcccgtaagttttgaggtgacttcagctccattgtgaaatagatagttctcttcatatttcataactacatttcaataattctaaactttctacattgatttttagatacttatttttcaagcttggtttctcagctgatcagatgaatttattcaacttcaatacaaagaaagacaaacctattatagtttcaagtgagtagatattatactgtacaggacagctatttgaacacacacatcactgctttagaaataaaaccgccaatttataaatgtatatgacctacattttataggaaaaaatgtttttaaatgctagtcatttatataatgtgctttgaaggatttgctagtccacttctgtcactttttagtacactggtatcttttatatgtaatgtatgctttttattattgtagcaaagcatttcagtagaaagaattttgcaacaatatgggggaaatttttcattgttggatttgaattatactggattttatctgtgtagtcttacttgtctttattttaatgctgtctgaagggaacttggtatccaaataaagcaggtaacctcattttacttcaagggcatactgtgtagtgctgaatttaatctgaaaatctgatgattttgaaaagaaaaacaagtttataaacattgtacagaagaaattaaatgtgtgtgatggaaatcctgatggtggagcacgttgaattttctgatatatagtgttattttcctgggatcccctatgccttctttgtatttcaactaataaaggaaaaaccctgtcattaaaactggtaagataataggatattctgattatacagtattactattcctatcccattttctgaccttttctcaatcactgtaaatttttattttctatttcctattgataattaaatatgtacataatatagacactgttgtatagaactaaatgaattgggttgctatgcttgagtgggtagtgaaatggaaatatttgatgaatactgagagttcctaaaatgctagagcaaatttccgagggaaaggggggcatcgtgtgtcttgggaaggttgcagcaggttgtttcttcaactccctaagaaatcattgggaaggactcaactgcaaactcgggatcagatacaaaatgggtctttccttcccctctcccccaaaaaataggagcactaaattttaaaatctactcaggtgacagttgctttgcaatgaaacttatcacattgaaattttcagtgttaaataaaaagagatttgtgatatttttaaatataaacttttacatcagtagtcagcagcctgacaattgaaatttggtaagtcgatatattttaaaatattttgctctccaaatagaattgtttttaaacaattgggaggttttttgtttctttaaatatgttttaattgtcattgtaaaaacaaaatcttgcttgaccctatattatgccatgaatgaattgctgagcctttataatacagtgacagcttgtttcatgcatagtcatggaacatagagatgttctttaaactgacctattgataagaggtttaatgagtttcacggctttcaacactattgtcatatagttatctttgccatttggagtttataaaaccattttatgtattgtgatactaaaggaagttgttttgctttactttaaattgaattattagactaatatttgcaaattctgcattttaaatgtggacactggctgtttgaaaaataaaatatagaatacagttttatggataattttcgagctgaatttttcacaatattctgaaccaaataacgaatggtaaatatgcaaaaatcatggtgcatagatataaccgtaaagagaaaagaatttctgtgtggaattaacagttacacaaattgggtaacaattatcagggcctttattatagctttatgtggaatgttattctaaaatgcaagagtcaaatgttactgtcattgaatattttagacttgaaacgtgtttatcatagagcgaagaaaatatgtgttcttttctttacagataagactctgttaacccactgtcagcatacgtgggatttcttttcttttttctttcattagtggagatttgttttcatccatctaccaccttgccagtaccctagcttgtgaccagcgggatgcattgtaagaaagttgtctgtggttaggagtgcagtctgggtccatggaacaaatttaaactaattggccctcgcaatgatcagtcctaggaccctggccttattattagcatggtgctttaaccaattgtacataataataccactgatagtctactaatgcatttcctagatcccagtttttcttgaatgattaggaatggtggggagaggggaggggagatattctacatgatacttctccaatcttctaaagattataagaaaaaataaaaaattgaagtcacttgaattaatgtgttgtcattgagtcttactcgacaatttatcatgcacaaagtgattatgaagattttcctgattatatgtttggattgaatttaaaaattttttttttcag

SEQ ID NO: 34883 - DNA, 566 bp, Homo sapiens
ctgtgttctgcagcgttttgttggatactattgataactggttctttaaggaaaggggcttaaacaggccttggtttgtagaggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatg

SEQ ID NO: 34884 - DNA, 1025 bp, Homo sapiens
ggaggaggaggaggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtgaaaaaccatttcaatgtagtcaatgtgacatgcgtttcatacagaagtacctgcttcagagacatgagaagattcatactggtgaaaaaccatttcgctgtgatgaatgtggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaa

SEQ ID NO: 34885 - DNA, 566 bp, Homo sapiens
aggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggcacacctctacattgtgttcagtgcctagtgtaattctgggcatgtattctagacagagtagatcggattggttctggcattgaataaggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaat

SEQ ID NO: 34886 - DNA, 2952 bp, Homo sapiens
agaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccgtcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagtt

SEQ ID NO: 34887 - DNA, 2960 bp, Homo sapiens
ctactgctctgggaggaggaagagaaggaggaagaggaggaggaggaggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcggggtcttattctgtcacctaggtggagtgcagtagtacagtcacagctcactgcagccccaacatcctgggctcaagccatcctcctgcctcagcctcccaagtagctgggaccacaggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccgtcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaa

SEQ ID NO: 34888 - DNA, 2949 bp, Homo sapiens
ggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccgtcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaa

SEQ ID NO: 34889 - DNA, 763 bp, Homo sapiens
ggaggaggaggcggaggggcgcggagaagctggcgcactttgggcctcggcggggtcgtctgcggcggccggacctcccagataccgcgccttctgggcctgccccgctggcgcagtcaggaccccttccctcaacgggatgggaaactttgtgagtggcttctccgcagccactaacaagtgtccgccagacagcgggggggccgccgaaggctgatgatggacacccgtttttcttcttattcctcttttacaaatcttctgttgaactgcattgtgtttacagtttcacgtctgtgaaaaggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatat

SEQ ID NO: 34890 - DNA, 2375 bp, Homo sapiens
ggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaagtttcaaagtatgcttttgaacttgtggataaacaggctttactggactcagaaggcaatgctgacattgatcaggttgataatttgcaggagggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccgtcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattc

SEQ ID NO: 34891 - DNA, 1008 bp, Homo sapiens
ggaggaggaggaggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtgaaaaaccatttcaatgtagtcaatgtgacatgcgtttcatacagaagtacctgcttcagagacatgagaagattcatactggtgaaaaaccatttcgctgtgatgaatgtggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagtt

SEQ ID NO: 34892 - DNA, 429 bp, Homo sapiens
aaaactcattacaactgtggagaacacacaaaagcattcagcggtaaacacacacttgttcagcagcagagaaccctcactacagaaagatgttacatatgcagtgaatgtgggaaatcctttagcaacaagtctaacctcattaaacatcggagagttcacactggggaaaggccatatgagtgcagtgaatgtgggaaatcctttagccaaaggtctgcactccttcaacatcggggagttcacactggggagaggccttatgagtgcagtgaatgtgggaagttttttacatatcattccagtctcataaaacaccagaaagttcacagtggatccaggccttatgagtgcagcgaatgtgggaagtcatttagccaaaactctagcctcattgaacaccatagggttcacactggagaaaggcct

SEQ ID NO: 34893 - DNA, 2746 bp, Homo sapiens
cctcttcgtggcggccattttagcttctctgaggtgtgttcaccggatcagagatagcagagcgccgagttggggccacgaaggcgtgaggggagtcgtcgtccctcctgcacgaaagcgtctaagccttggcgacgccgccctgggggacccacgtcaggcctgggatagggaccgctgtccccgggtccctaccaatgtcgcccgtcgctcccggcccagctctacccgcagagtctgatggcagcggccactctgaggacgccaactcagggcactgtgacctttgaagatgtggccgtacacttctcctgggaggaatggggtctccttgatgaggctcaaagatgcctgtaccgtgatgtgatgctggagaacttggctcttttaacctctctagatgttcatcatcagaagcagcaccttggagaaaaacatttcagaagcaatgtgggcagagccttgtttgtgaagacctgcacattccatgtgtcaggggagccttccacctgcagagaagttgggaaggacttcctggccaagttgggatttctccatcaacaggctgctcacactggggagcaatcaaatagcaaaagcgacggtggggccatcagtcacagaggaaaaactcattacaactgtggagaacacacaaaagcattcagcggtaaacacacacttgttcagcagcagagaaccctcactacagaaagatgttacatatgcagtgaatgtgggaaatcctttagcaaaagctacagtctcaatgaccattggagacttcacactggagaaaagccttatgaatgtcgagagtgtgggaagtcctttaggcaaagctctagtctcattcagcaccggagagttcacactgcagtacgacctcatgaatgtgatgaatgtggaaaattatttagcaacaagtctaacctcattaaacatcggagagttcacactggggaaaggccatatgagtgcagtgaatgtgggaaatcctttagccaaaggtctgcactccttcaacatcggggagttcacactggggagaggccttatgagtgcagtgaatgtgggaagttttttacatatcattccagtctcataaaacaccagaaagttcacagtggatccaggccttatgagtgcagcgaatgtgggaagtcatttagccaaaactctagcctcattgaacaccatagggttcacactggagaaaggccttataagtgcagcgaatgtgggaaatcctttagccaaaggtctgcactccttcaacatcggggagttcacactggggagaggccttatgagtgcagtgaatgtgggaagttctttccctacagctccagtctccgaaaacaccagagagttcacactggatcaagaccctatgagtgcagtgaatgtgggaaatcctttactcaaaattccggcctcattaagcacaggagggttcacactggggagaagccttatgagtgcacggaatgtgggaaatcctttagccataactccagccttattaaacatcagagaattcatagtcgataaaagccttatgagtggcaaatgtggaaaatctgttagcaccctggagaaagtccttgagtacacagtgaatgtcagaaagcttcagctgaaggccatatctcattgagtgccacacagttcacaagggaaagacacttttgatatgtagggatgtccagttgatataacagctctgaaggagatcccttatgagggtggcatcagcctgaattgaacatcctatatctgaacatctgcataaattccaggtatgtgtgaactgcattgcaccttttgccctgcccagggcccatgtcagatttatgtctctgctgatactatagtggaagccattttacctctactgcctggcaggtgaccaccagtgtgcaccactcacccatcccagtgtattcaggtaagtgaaccttggtgttctgttcatgggaggaatttgtaaatagcctaagcatttattccgttttttttttttcctttctgatgagttaggccatggacctgacccagtttggcccagaggactctgctggtgacctgaaaagagggactacatatttcaggatattgttggtctcacatgactcttgatagagtttgccagccttcaaatcaccaactgtgggaaccaactgcctcttattgccttggtttgtacaataacaaaggccttattaatcttgggggttctatatgtatgggttggtttgaaaacagttgggttctgctaacatgaaggggtgaataactttttttggagatcccaaacattgtgtagctcaacagggacagggacagggacagtaggatggcagaatatagctctctctctagtttgagcctagttttcattgctattcaaggcctctgagaaaaaactacagggtattgtcctaatttatatcctggatgccatagaggtcagcctgaggaggcagcagttacttgacatcctttgatgtttctgaaagcaacatgaaattgttctcttgttcacaaggaatactgcatcgtgttcagtgccagtgggggaaatctgttccccaggtcctgtatgccttgatatcctgaattccacagggtagcaccacaggtggtaagattatagtaggaattataattgttatagaagtactggattgatagagagtggaaaactgcaataacactgcaataaatagaatgtgcccctttt

SEQ ID NO: 34894 - DNA, 5687 bp, Homo sapiens
cggatcagagatagcagagcgccgagttggggccacgaaggcgtgaggggagtcgtcgtccctcctgcacgaaagcgtctaagccttggcgacgccgccctgggggacccacgtcaggcctgggatagggaccgctgtccccgggtccctaccaatgtcgcccgtcgctcccggcccagctctacccgcagagtctgatggcagcggccactctgaggacgccaactcagggcactgtgacctttgaagatgtggccgtacacttctcctgggaggaatggggtctccttgatgaggctcaaagatgcctgtaccgtgatgtgatgctggagaacttggctcttttaacctctctagatgttcatcatcagaagcagcaccttggagaaaaacatttcagaagcaatgtgggcagagccttgtttgtgaagacctgcacattccatgtgtcaggggagccttccacctgcagagaagttgggaaggacttcctggccaagttgggatttctccatcaacaggctgctcacactggggagcaatcaaatagcaaaagcgacggtggggccatcagtcacagaggaaaaactcattacaactgtggagaacacacaaaagcattcagcggtaaacacacacttgttcagcagcagagaaccctcactacagaaagatgttacatatgcagtgaatgtgggaaatcctttagcaaaagctacagtctcaatgaccattggagacttcacactggagaaaagccttatgaatgtcgagagtgtgggaagtcctttaggcaaagctctagtctcattcagcaccggagagttcacactgcagtacgacctcatgaatgtgatgaatgtggaaaattatttagcaacaagtctaacctcattaaacatcggagagttcacactggggaaaggccatatgagtgcagtgaatgtgggaaatcctttagccaaaggtctgcactccttcaacatcggggagttcacactggggagaggccttatgagtgcagtgaatgtgggaagttttttacatatcattccagtctcataaaacaccagaaagttcacagtggatccaggccttatgagtgcagcgaatgtgggaagtcatttagccaaaactctagcctcattgaacaccatagggttcacactggagaaaggccttataagtgcagcgaatgtgggaaatcctttagccaaaggtctgcactccttcaacatcggggagttcacactggggagaggccttatgagtgcagtgaatgtgggaagttctttccctacagctccagtctccgaaaacaccagagagttcacactggatcaagaccctatgagtgcagtgaatgtgggaaatcctttactcaaaattccggcctcattaagcacaggagggttcacactggggagaagccttatgagtgcacggaatgtgggaaatcctttagccataactccagccttattaaacatcagagaattcatagtcgataaaagccttatgagtggcaaatgtggaaaatctgttagcaccctggagaaagtccttgagtacacagtgaatgtcagaaagcttcagctgaaggccatatctcattgagtgccacacagttcacaagggaaagacacttttgatatgtagggatgtccagttgatataacagctctgaaggagatcccttatgagggtggcatcagcctgaattgaacatcctatatctgaacatctgcataaattccaggtatgtgtgaactgcattgcaccttttgccctgcccagggcccatgtcagatttatgtctctgctgatactatagtggaagccattttacctctactgcctggcaggtgaccaccagtgtgcaccactcacccatcccagtgtattcaggccatggacctgacccagtttggcccagaggactctgctggtgacctgaaaagagggactacatatttcaggatattgttggtctcacatgactcttgatagagtttgccagccttcaaatcaccaactgtgggaaccaactgcctcttattgccttggtttgtacaataacaaaggccttattaatcttgggggttctatatgtatgggttggtttgaaaacagttgggttctgctaacatgaaggggtgaataactttttttggagatcccaaacattgtgtagctcaacagggacagggacagggacagtaggatggcagaatatagctctctctctagtttgagcctagttttcattgctattcaaggcctctgagaaaaaactacagggtattgtcctaatttatatcctggatgccatagaggtcagcctgaggaggcagcagttacttgacatcctttgatgtttctgaaagcaacatgaaattgttctcttgttcacaaggaatactgcatcgtgttcagtgccagtgggggaaatctgttccccaggtcctgtatgccttgatatcctgaattccacagggtagcaccacaggtggtaagattatagtaggaattataattgttatagaagtactggattgatagagagtggaaaactgcaataacactgcaataaatagaatgtgccccttttacagaggtttccatgatgttcgttattatggctcttaaggatgagcaggtacagaaatcctcaggacctacagaattgtgtatcttgtgtagctgaggtcattgtcagaaattttatggaatcctgtagcctctgggattttcacctcaaggtcattgctatgcaggcaggaaaacaaggatagagaagggaggtctaggccattgatacagcctttgtgatccagccaacatttctgttgagtcaggtggaaatggccttcactgttcacttgtatttgtgatcactgaggcaaaatcctctcccaggacatgaggagagagatggtggaatcaacatagggttgtcaaacctgattttccaaaaacaataggaaattcagacttttattttgaaccatattttgttaggttggtgcaaaagtaactgtggttttgaaccatgatttatttttatttttatttttttttgagtcagagtcttgctctgttgcccagtctggagggcaatggcactatctcagctcattgcaacctccgcctcccaggttcaagcgattcttctgcctcagcctcccaggtagctgggattacaggcacccgccaccacgcccatctgagttttgcatttttagtagacatggggtttcaccatgttggccaggctggtcttgaactcctgacttcatgtgatccacccaccttggcctcccaaagtgctgggatttacaggcatgagccactgcgcccagccaagctttttcaccattccaatttccttcaaatgctgaacagccgtggaatggttgacattgagttcttaggcaacttctcatgtagttgtaagaggatcagcttctaatattgctctcaattggtcattgtcaacttccagtggctggccactacttctcttcaaggctcttgtctcctttgcaaaacttcttgaaccaccactgcactgtacattcgttagcagttcctgggccaaatgtgtttatatcgtgagttgtctctgctgctttacgacccattgggaactcaagtaagaaaatctcagccgggtgcggtggctcacgcctgtaatcccagcactttgggaggctgaagtaggtggatcacaaggtcaggagttagagaccagcctgaccaacatattgaaacctcatctctactaaaaatacaaaaattagccgggcgtggtggcatgtgcctgtagtcccagctacttgggaggctgaggcaggagaatcacttgaacccgggaggcagaagtcacagtgagccaagatcacgccactgcactccagcctggacgacagacaaaacaagactccgtctcaaaaaaaagaggccagatgcggtggcttacacctgtaatcccagcactttgggaggccgaggtgggtggatcacaggtcacgagttcgagaccagcctggccaacatggtgaaaccccgtctctactaaaaatacaaaaattagctgggcatagtggcatgcacctgtaatcccagctactggggagcctgaggcacgagaattgtttgaaccccgggaggtggaggttgcagtgagccaagatcatgtcactgcactccagcctgggcaacagagcaagactctatctcaaaaaaatcgctgaaatttgagttttgtctaacatttccatagtctaaaataaacataaacagcaagtagtaagtcagcaaaaaaacataaagcgagaaatgcctattaaaatgatgtataaccacatttatttaagaatgttttccaatataaaatggcaaaatccaacatgcaaaaacggcaattacttttgcactaacctgataataattttaataagaataaatggtacatatttaaactatataatttgatcagctttgatattcatattaacctgtaattgctcccaccatgccaattttgaaactgccaacatgttactgaatgtagaattgggaagagttgctgatagcatcctaatatattctgtttctaccatactgatacagtggccacgaataacctcaagaatgtagaaaataaaatgtagtgaaatgattaggaagaagttgtttcttcacaatcatgacaatgaacgtgtcattccacaagttacctcattgtcctttaataattatctgcctataggcaactattgatttactttccattataatacattagttttcatttgctagaattttatatgattgaaaccataatgtatttactcttttttaatccctgggtatagtcacgtatttattttgagattcatcattatacctctatgagtagtttcttttttttgtattgctgagaagtatgatgttctgtggatataccagtattcgtttattcattcattcatttgttatggatattttgagtagttttttaaagtagtttgaggtataatggaacttaaagtgcttatatttaaaatgcatattttgatattttcatacatgcttacaccctggaacgcagtttccttctgtctttttagttcattctcaacatataaaattaattttcattgtgtaaaattactggtacaatgacatattttgtctcctgttacagctgtgttcaattacaaaaaaagatggaaaagactgttatgaagccagatgaacctttctccagtcttccttcactatttttttttccttcaccatttatcatttcatagtcatttatgtttcatcggtcctcatgtgtactagtgcgttattttacttatactcccggatatcatattatttaatgcatagcctcttcagaatgcaattttaaaatgtaaaggctcttttataaccccccaaaaaatcacacaaatatattttaaaatgtaaatattttatcgcttctgttttctcagttgtctaaaacaatgtgtttcttaaggaagatcatttttattcaggatccaaatgtatatttaatagctttcagtagttgtatctcataagtctgtaacctacaggttccatttacctttgttttcttatttcttgaagttgctgagtcattttttaattagaatttgctgtattct

SEQ ID NO: 34895 - DNA, 2673 bp, Homo sapiens
ctccgagcaggacactgctacttaacaaggtggtttgagccaagtatgtgtcttgcgggtctttgcgaaagtgaaccagttattaggggcgcctaacgacctggggggtcaactaaggggactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccatcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcgtaaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagaaaaaccatataattgtaaagaatgtgggaagagcttcagatggtcctcatgccttttgaaccatcagcgagtccacagtggagaaaaaagcttcaaatgtgaagaatgtggaaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataattgttcatatttatggggtacaacgtgctattttaatgtgtgcatacaatttatagtgatccaatcagtgtaattggtgtatctgttacctcaaacatttaccatttctttgtgttggaaaattcaaaatccatttgagaggagttggtagacagcaagggaagggtccctggagacccccagccaaacgggtcagtgtctcatccccacataacacaaaaagcagcctggggaagacaatcaagctacaggcactgataagggaactagcacaggggattgtgcctggagacatgcccatggctgcacagatagaagaacctccagcccattcaggtaaaaactcgcacaaacctccggctcactcagttaagggaacaagaccagacacagaaatgcctttgtcctttgtataatcagcaggctccgaggaaaaagtttcttcttttgtgggcatgaacacagtgggcttcagtaggttcaggttggcactttcttttgtggaaaaggaaaagcccagcctctgtaaatcatcacttcagctcctgattggtcccaggccaagctgaatagcccttaggaataatcacttcaactcctgattggtcccgggccaagctgaatagcccttatgaatcatcacttcggttcctgattggtcccgggccaaggtcccagaccaagctgaatcacgctttctccaagacagcccgcaggctaagtgcattccttccccttcccagtccataaaaaccccggaccccagcctcatactgggcaacttatttggatccccatctccactgtggagagcttttttctttcacttattaaacttttactccaatttc

SEQ ID NO: 34896 - DNA, 2222 bp, Homo sapiens
acttccggtctccgagcaggacactgctacttaacaaggtggtttgagccaaactgtggcacgtttcaggcaggattcctccttcattcaaactgcatcacccaggagtctgcaaattccccaaagtaggaggaaaaatgaccacattcaagattaccaagactgtgggaatacttataacctgctcttggtcatgataaagagaagcaaagtacttgtattctgttcaaagattatggaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccatcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcgtaaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagaaaaaccatataattgtaaagaatgtgggaagagcttcagatggtcctcatgccttttgaaccatcagcgagtccacagtggagaaaaaagcttcaaatgtgaagaatgtggaaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataattgttcatatttatggggtacaacgtgctattttaatgtgtgcatacaatttatagtgatccaatcagtgtaattggtgtatctgttacctcaaacatttaccatttctttgtgttggaaaattcaaaatccatttgagaggagttggtagacagcaagggaagggtccctggagacccccagccaaacgggtcagtgtctcatccccacataacacaaaaagcagcctggggaagacaatcaagctacaggcactgataagggaactagcacaggggattgtgcctggagacatgcccatggctgcacagatagaagaacctccagcccattcaggtaaaaactcgcacaaacctccggctcactcagttaagggaac

SEQ ID NO: 34897 - DNA, 1731 bp, Homo sapiens
acttccggtctccgagcaggacactgctacttaacaaggtggtttgagccaaactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccatcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcgtaaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagaaaaaccatataattgtaaagaatgtgggaagagcttcagatggtcctcatgccttttgaaccatcagcgagtccacagtggagaaaaaagcttcaaatgtgaagaatgtggaaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataattgttcatatttatggggtacaacgtgctattttaatgtgtgcatacaatttatagtgatccaatcagtgtaattggtgtatctgttacctcaaacatttaccatttctttgtgttggaaaattcaaaatccatttgaga

SEQ ID NO: 34898 - DNA, 2318 bp, Homo sapiens
agccttaccccttactggaggctgcaggaccctctacacacagacagctgtccagcacggaaggtgggctgaggcccagggtgaacatgccagctaatgggacatcaccccagagattccctgccctgattccaggagaacctggcagatcttttgaggggtccgtgtcattcgaggatgtggctgtggatttcacccgacaggagtggcacagactggaccctgctcagaggaccatgcacaaggatgtgatgctggagacctacagcaacctggcatctgtgggcctctgcgtggccaaaccagagatgatcttcaagttggagcgaggagaagagctgtggatattagaggaggaatcctcaggccatggttactcaggatctctctcactgctgtgtggcaatggttctgttggggataatgccctcaggcatgataatgaccttcttcaccatcagaagattcaaacattggatcaaaatgttgaatataatggatgcaggaaagccttccatgagaaaacaggctttgttagacgtaaaagaacacccagaggagataaaaactttgaatgtcatgaatgtgggaaagcttactgtaggaagtcaaaccttgttgaacatctgagaatacacacaggagagagaccctatgaatgcggtgaatgtgcaaaaaccttcagtgcaagatcatacctcattgctcatcagaaaactcacacaggggagaggccctttgaatgtaatgaatgtgggaaatcttttggcaggaagtcacaactcatcctacatacaagaacacacactggagagagaccctatgaatgtactgaatgtgggaaaaccttttctgagaaggcaaccctcacgattcatcagagaactcacacaggggagaaaccctatgaatgtagtgaatgtgggaaaacatttcgtgtaaagatatcccttacccaacaccacagaactcatacaggggagaaaccttatgaatgtggggagtgtgggaaaaacttccgtgcaaagaaatccctaaatcagcatcaaagaattcacacaggtgagaaaccctatgagtgtggtgaatgtgggaaattcttccgaatgaagatgactctcaataatcatcaaagaactcacacaggtgaaaagccctatcagtgtaatgaatgtgggaaatctttcagggtgcactcatctcttgggatccatcagagaattcacacaggagagaaaccttacgaatgtaatgagtgtggtaatgctttctatgtgaaagcacgcctaattgaacatcagaggatgcattcaggagagaaaccctacgaatgtagtgaatgtgggaaaatcttcagtatgaagaaatccctttgtcaacaccggagaactcacacaggagagaaaccttatgaatgtagtgaatgtggaaatgccttctatgtgaaagtacgcctcattgaacatcagcgaattcacacaggagagagaccctttgagtgtcaagaatgtgggaaagctttctgccggaaagcacacctcacagaacatcagagaactcacataggctggtcctggcgttgtacaatgaagaaagcctctcactgaagacttccctcaccattggatcaagctccttgggggcatatgatcaccagggcacacagtgtgcctgtgaaaatttggcacctacatttgtatcaaagtatgtcctgatccccttaggggatagctcattgtttttattcagatttccctaattagtggtgtgtgaacatcttatctgttgattggctatttgggttttttcttctgtgcattgactgttcatgtcctctgctcattgttttcaaatgggctgttcatctcttgctttttggtttaaatgttgttttttaacatatgagaatataaaaatcctttttttttcagtcatatgtgttgcaaatatcttctcccagactgtcgttggttttttaaattttgccatctgttttcttctgctgaagttttatattttatttatttattttttatttttttgagatggagtctcactctgtcacccaggctggagtgcaatggcatgacctcagctcatttcaaccttcgcctcccgggttcaagcgattctcctgcctcagtctcccaagtagctgggattacaggtgtgcaccaccatgcctggctaatttttgtatttttagtaaagacggggtttcaccatgttggccaggctggtctctaactcctgacctcaggtgatccacctgcctcggcctccaaaagtgttgggattacaggtgtgagccaccgtgc

SEQ ID NO: 34899 - DNA, 2616 bp, Homo sapiens
aattcggggcgggacttccgggggtcagccggcgttggctgagacgtcttcgtgccacggtgctgcctcctttccaagcgcgacccgttgagatccccttgaccacaccctcattctcagctggtgctcatgaaggacagaagagtcaatgtcagtacaatgtgagtgaagggctgaggtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcaggaggctgccacagtccctctcccaggagggggacttcacaccagctgccatggggctccttaggggccccttaggggagaaagatctggactgtaatggttttgacagtcgcttcagtctgagcccaaacctgatggcatgtcaggaaatccctacagaagagaggccacatccatatgacatgggtggccagagtttccagcacagtgtggacctaactggtcatgagggggttcccacagctgaaagtccactcatatgtaatgagtgtgggaaaaccttccaaggaaatcctgaccttattcagcgtcaaatagtccacactggggaggcttcctttatgtgtgatgattgtgggaaaaccttcagccagaactcagttcttaaaaaccgtcatcgatctcatatgagtgagaaagcttaccagtgcagcgaatgtgggaaagccttccgagggcactcagacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggccttcaggcgaagctcaaacctcatcaaacaccacaggactcacacaggagagaagccttttgagtgtggcgagtgtgggaaagccttcagccagagtgcacacctgaggaagcaccagagggtccacactggagagaagccttatgagtgtaatgattgtggcaagcccttcagtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgacaagccctacgcctgccacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaaccagtgtggtaaagccttcaaccgaagctcaaatctcattcaccaccagaaagttcatactggggaaaaaccctacacctgtgttgaatgtggtaagggcttcagccagagctcacacctcattcagcatcagataatccacacgggcgagcgcccctacaaatgcagtgagtgtgggaaagccttcagtcagcgttcggtcctcatccagcaccagaggattcacactggggtgaagccctatgactgtgctgcttgtgggaaagccttcagccagcgatcaaagttgatcaaacaccagttgattcacaccagggaataggctgttgggctggcaggagtgaaaccgagcatagtttcctctccaactcctctttggccattgtctcagcctctgccacttcccagaccgaaagcctggactcagctcactgcctacatccagtggccacatagcctgggaccctcctttgaaacatcctttacaggctcccttctcactgccactgctcttgcctcttgtgatgtcttgggtttgggcttgtttttacagcttgtgaacggactgcacgtttgttacaagggagaagattatggaggctgcatattcatgaatagagtttattattataatgaaaagttaccaaaaaagtaaagtgacgtttggtttgagataaccatagtagtttgtttgattggtaa

SEQ ID NO: 34900 - DNA, 2503 bp, Homo sapiens
aattcggggcgggacttccgggggtcagccggcgttggctgagacgtcttcgtgccacggtgctgcctcctttccaagcgcgacccgttgaggtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcaggaggctgccacagtccctctcccaggagggggacttcacaccagctgccatggggctccttaggggccccttaggggagaaagatctggactgtaatggttttgacagtcgcttcagtctgagcccaaacctgatggcatgtcaggaaatccctacagaagagaggccacatccatatgacatgggtggccagagtttccagcacagtgtggacctaactggtcatgagggggttcccacagctgaaagtccactcatatgtaatgagtgtgggaaaaccttccaaggaaatcctgaccttattcagcgtcaaatagtccacactggggaggcttcctttatgtgtgatgattgtgggaaaaccttcagccagaactcagttcttaaaaaccgtcatcgatctcatatgagtgagaaagcttaccagtgcagcgaatgtgggaaagccttccgagggcactcagacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggccttcaggcgaagctcaaacctcatcaaacaccacaggactcacacaggagagaagccttttgagtgtggcgagtgtgggaaagccttcagccagagtgcacacctgaggaagcaccagagggtccacactggagagaagccttatgagtgtaatgattgtggcaagcccttcagtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgacaagccctacgcctgccacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaaccagtgtggtaaagccttcaaccgaagctcaaatctcattcaccaccagaaagttcatactggggaaaaaccctacacctgtgttgaatgtggtaagggcttcagccagagctcacacctcattcagcatcagataatccacacgggcgagcgcccctacaaatgcagtgagtgtgggaaagccttcagtcagcgttcggtcctcatccagcaccagaggattcacactggggtgaagccctatgactgtgctgcttgtgggaaagccttcagccagcgatcaaagttgatcaaacaccagttgattcacaccagggaataggctgttgggctggcaggagtgaaaccgagcatagtttcctctccaactcctctttggccattgtctcagcctctgccacttcccagaccgaaagcctggactcagctcactgcctacatccagtggccacatagcctgggaccctcctttgaaacatcctttacaggctcccttctcactgccactgctcttgcctcttgtgatgtcttgggtttgggcttgtttttacagcttgtgaacggactgcacgtttgttacaagggagaagattatggaggctgcatattcatgaatagagtttattattataatgaaaagttaccaaaaaagtaaagtgacgtttggtttgagat

SEQ ID NO: 34901 - DNA, 1295 bp, Homo sapiens
gcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctgtcccccgcccacttcatccctcaggcacctcccaactcctggcctctctgcacgaggcgcctgccccgggccccgcctacaggggacccagctcttcttgcagccactggaagctgatcacctggagtgaagacctcacacgaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgccggaatgtgtcaaaggcgtggtcacagacctgctcaggagatggaaacattggctgctgctccttggcatctgctgccccaaacctcatggaagagtctccagccgtctccgcctgtcgaggtccctcggccatttcttccattctgcttttgccactttcatgggggtgtgtgataagcgagtgggttctatcttctaagattgttctcagcataaccgtaaagacacctaacaaaatccttctgtcattgatcctcagtcttacatggggtgcgtattctgtttttccaggcttcagcacagaaatacaagtactgcatgttgtcacttacatttggaatctaaaccaataaaactaatagcagcaaagagtagaatgtgggttaccacaggttggggactggagggaatagggagatgttggtcactgggtgaaaacattaggagtaaatgataggtttttgagatgacttatatggtaataggcttgtttccatcagtccatattgtatacctataacagaatatcagtttgtttcctgtaaatatatataactataatttgtcaatatagaatttttttaaaaatcatattccagttcttattgtgttggttctaaataaaaatgcttctttctctt

SEQ ID NO: 34902 - DNA, 4219 bp, Homo sapiens
gcagttgcccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgccggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaaatgagtgtggtgaggtcattaggtacaattcactcctttcacatcagttaatttcattcttgacagaatccttacaaatgtagtgacagtggccaatccctcatgagttgaagcattaatagatatgagaggccataagcaagagacatcatgtaaacatatgtggcagagggtctatccaggcctcgcaggttactaggcatcaagatttatatctttgatgaaacgaaacaaatgtaatatgcatcctgaggccattacccagtgaccgatggtaagtgaggattcctaggaggaataacagtctctggtttccctgtttgcctttgatattatacactgtagaatactcacaagtccaaatatgctaaaaattatatatttttaactcacatacgaaaaggttgcaggatatttgtaggcagtcagttaccttcaccttatgaaatgtttcactgagttatttgaggttttttggaaagcctactattgcgtttcaatgtgaactttgaaatcttattgtgcatccttacacaccttccatggtgctttcttggaaagatcattgggatggaaggatcattgattgggtgaagatcattgattaggtgaaggattatttctatccaatttgtgaagaaggaggactttgcttttaaaattaagtatcatctgaattagcatttgggagtggcgaaaaacaatgtaaaactatgatgtcactcaccattctgataatgttcagggtgcctttctcctaccaggagagtactgtggcttagaggaaagaaatggtctatcaactgaacatgaaatggagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcaggagagtgcttgaacccaggaggcggaggttgtggtgagccaagatcatgccactgcactccagcctgggcaacaagaacaaaactccatctaaagaagaaaaagaaaaactgaagagagagtagttgtcagagtgaagagtttaatcaacagaagtagagtaacatattctttagtagaactcacattatctgcttgaagcacattttgctaatgttttattcagaatgtatcatagatataatgttttaactaataaaatagaatggtttttctcta

SEQ ID NO: 34903 - DNA, 4336 bp, Homo sapiens
gcagttgcccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggcacctcccaactcctggcctctctgcacgaggcgcctgccccgggccccgcctacaggggacccagctcttcttgcagccactggaagctgatcacctggagtgaagacctcacacgaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgccggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaaatgagtgtggtgaggtcattaggtacaattcactcctttcacatcagttaatttcattcttgacagaatccttacaaatgtagtgacagtggccaatccctcatgagttgaagcattaatagatatgagaggccataagcaagagacatcatgtaaacatatgtggcagagggtctatccaggcctcgcaggttactaggcatcaagatttatatctttgatgaaacgaaacaaatgtaatatgcatcctgaggccattacccagtgaccgatggtaagtgaggattcctaggaggaataacagtctctggtttccctgtttgcctttgatattatacactgtagaatactcacaagtccaaatatgctaaaaattatatatttttaactcacatacgaaaaggttgcaggatatttgtaggcagtcagttaccttcaccttatgaaatgtttcactgagttatttgaggttttttggaaagcctactattgcgtttcaatgtgaactttgaaatcttattgtgcatccttacacaccttccatggtgctttcttggaaagatcattgggatggaaggatcattgattgggtgaagatcattgattaggtgaaggattatttctatccaatttgtgaagaaggaggactttgcttttaaaattaagtatcatctgaattagcatttgggagtggcgaaaaacaatgtaaaactatgatgtcactcaccattctgataatgttcagggtgcctttctcctaccaggagagtactgtggcttagaggaaagaaatggtctatcaactgaacatgaaatggagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcaggagagtgcttgaacccaggaggcggaggttgtggtgagccaagatcatgccactgcactccagcctgggcaacaagaacaaaactccatctaaagaagaaaaagaaaaactgaagagagagtagttgtcagagtgaagagtttaatcaacagaagtagagtaacatattctttagtagaactcacattatctgcttgaagcacattttgctaatgttttattcagaatgtatcatagatataatgttttaactaataaaatagaatggtttttctcta

SEQ ID NO: 34904 - DNA, 4229 bp, Homo sapiens
cctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggcgcctgccccgggccccgcctacaggggacccagctcttcttgcagccactggaagctgatcacctggagtgaagacctcacacgaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgccggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaaatgagtgtggtgaggtcattaggtacaattcactcctttcacatcagttaatttcattcttgacagaatccttacaaatgtagtgacagtggccaatccctcatgagttgaagcattaatagatatgagaggccataagcaagagacatcatgtaaacatatgtggcagagggtctatccaggcctcgcaggttactaggcatcaagatttatatctttgatgaaacgaaacaaatgtaatatgcatcctgaggccattacccagtgaccgatggtaagtgaggattcctaggaggaataacagtctctggtttccctgtttgcctttgatattatacactgtagaatactcacaagtccaaatatgctaaaaattatatatttttaactcacatacgaaaaggttgcaggatatttgtaggcagtcagttaccttcaccttatgaaatgtttcactgagttatttgaggttttttggaaagcctactattgcgtttcaatgtgaactttgaaatcttattgtgcatccttacacaccttccatggtgctttcttggaaagatcattgggatggaaggatcattgattgggtgaagatcattgattaggtgaaggattatttctatccaatttgtgaagaaggaggactttgcttttaaaattaagtatcatctgaattagcatttgggagtggcgaaaaacaatgtaaaactatgatgtcactcaccattctgataatgttcagggtgcctttctcctaccaggagagtactgtggcttagaggaaagaaatggtctatcaactgaacatgaaatggagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcaggagagtgcttgaacccaggaggcggaggttgtggtgagccaagatcatgccactgcactccagcctgggcaacaagaacaaaactccatctaaagaagaaaaagaaaaactgaagagagagtagttgtcagagtgaagagtttaatcaacagaagtagagtaacatattctttagtagaactcacattatctgcttgaagcacattttgctaatgttttattcagaatgtatcatagatataatgttttaactaataaaatagaatggtttttctctatgaatgaa

SEQ ID NO: 34905 - DNA, 3528 bp, Homo sapiens
gtgttcacggccggctagacattctgtgctcgtgcaggaggagggctgctaccatcagggacgtgcacgatttcccccaccccgccccctccccaaactccaaaaaaaaatccaaaacacactgccacccaccgtgcccccgcgccccgagcccctccggtcccggcctgcgtttgctagcgagcgcggggaacccacggcagtgtctgtgcctgtgccaggctgcaggatatgggtctgcaggatggagttcttccggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacttactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgcccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagttttaataactttaaaagtacttcagatagacgcagaaaattggtgagtggttgaccaagaacactgcacaaatataaaaaaagttctggaaatgcagaatggcgttagatttatatttggtttgttaattttatatcactgtttttcactgtttttgtggacaaataatggttgctttgctgaagtgttcttcctcaatcttgattgccctgtacctacccaaaagctgtagtcacacatcctaaaggccaagcaaacccaccgggatggtggggggtcttggagccaagctcttaggttcctcttatttggggcagtaccagtccataccagctgcgatttgtgagtggacctgtggtaagaagaatagaaaaggctctcagagataaggttttttacatgtgtaacaatcccaagatttcctagattaaaatcttaattgattttgaaattggatttttatttagaatcaaaattaggacaagaacagataacttcttcagatacatttgtgtaactttacagaatgtcatcaagctttggggctctgtggggcacatgatttatccataaaggagatgcagtatgcttacttaaattaataaatttaaaatcttttaagtgtgtaaatagtagtgttggtcttacgtatttcaagtaaaaagtagacagctgcactttttttgcacattggattaaaataacttccatcagcaacaaacatcagactgtttttaacaaatattaaagattgtcagaccaaatgtttatgttttcgaaatatatttcatcactggttacagttttaaatagaagttgattgccttttcatagccgtaaatgagaattataaactctattccagttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgttcctaggctgttttaaccaaagcaaaggaaaaataattttaacatcttgtcaatagctacttcaacaaaccatattttgggacttcattttttgtatataaaagaaaatatacttctatca

SEQ ID NO: 34906 - DNA, 3497 bp, Homo sapiens
gtgttcacggccggctagacattctgtgctcgtgcaggaggagggctgctaccatcagggacgtgcacgatttcccccaccccgccccctccccaaactccaaaaaaaaatccaaaacacactgccacccaccgtgcccccgcgccccgagcccctccggtcccggcctgcgtttgctagcgagcgcggggaacccacggcagtgtctgtgcctgtgccaggctgcaggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacttactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgcccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagttttaataactttaaaagtacttcagatagacgcagaaaattggtgagtggttgaccaagaacactgcacaaatataaaaaaagttctggaaatgcagaatggcgttagatttatatttggtttgttaattttatatcactgtttttcactgtttttgtggacaaataatggttgctttgctgaagtgttcttcctcaatcttgattgccctgtacctacccaaaagctgtagtcacacatcctaaaggccaagcaaacccaccgggatggtggggggtcttggagccaagctcttaggttcctcttatttggggcagtaccagtccataccagctgcgatttgtgagtggacctgtggtaagaagaatagaaaaggctctcagagataaggttttttacatgtgtaacaatcccaagatttcctagattaaaatcttaattgattttgaaattggatttttatttagaatcaaaattaggacaagaacagataacttcttcagatacatttgtgtaactttacagaatgtcatcaagctttggggctctgtggggcacatgatttatccataaaggagatgcagtatgcttacttaaattaataaatttaaaatcttttaagtgtgtaaatagtagtgttggtcttacgtatttcaagtaaaaagtagacagctgcactttttttgcacattggattaaaataacttccatcagcaacaaacatcagactgtttttaacaaatattaaagattgtcagaccaaatgtttatgttttcgaaatatatttcatcactggttacagttttaaatagaagttgattgccttttcatagccgtaaatgagaattataaactctattccagttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgttcctaggctgttttaaccaaagcaaaggaaaaataattttaacatcttgtcaatagctacttcaacaaaccatattttgggacttcattttttgtatataaaagaaaatatacttctatc

SEQ ID NO: 34907 - DNA, 2107 bp, Homo sapiens
gtccgggtttggggatccagatgtccagccccgtgtccccctccaaacatccagtccctctcatattgcctttgaaattagcagcctctgggtgaccagaccttggccctcagaggaatcccggagaaaggtagaaccagcttcggcgttgggaacgcaggcgcgcttacgcatttagtgagggtttggcggtctccatagttaccgccgccgcgcgtgacgtcatagtggagcgctgagggcttggtggcgtggggtgggggctgtcctactgatcctgaatttggggtcactggtaagaggagttgcccattccagccaggtggaacggggaggggtgccacatgtctcagatctgccattgtctgcgaaaagaaactgctgcgaggaccatccccaatcccctgcttcccttgggaagagtaaccgccgttttgtaggacacttggggacaaccccgcttgtcctgaaatttattgacacggtaaatagtatttcctgtgtgccgaggatgcagttaaaccaacactgaccccctgcccttgagaaacacaagatggctacagaaccaaagaaagctgcagcccagaactctccagaggatgaaggacttctgatagtgaagatagaagaggaagaatttatccatgggcaggacacttgcttacagagaagtgaactccttaagcaggagctctgcaggcagctttttaggcagttctgctaccaggattctcctggacctcgcgaggcactgagccgcctccgggagctctgctgtcagtggctgaagccagagatccataccaaggaacagattctggaactgctggtgctagagcagttcctgaccatcctgccaggagatttgcaggcctgggtacatgaacattacccagagagtggagaggaggcagtgaccatactagaagatttggagagaggcactgatgaagcagtactccaggttcaagcccatgaacatggacaagaaatattccagaaaaaagtgtcacctcctggaccagcacttaatgtcaagttacagccagtggagaccaaggcccattttgattcatcagaaccccagctcctatgggactgtgataatgagagtgaaaacagtagatccatgccaaagctggaaatttttgaaaaaattgaatcacagagaattatatctggaagaatctcaggatacatatcagaagcatctggtgagtctcaagacatctgtaagtctgcaggcagggtaaagagacaatgggaaaaagaatcaggggagtctcagagactctcgtctgcccaggatgaaggttttggtaaaatcctcacccacaaaaatacagtcagaggtgaaataataagccacgatggatgtgagaggagattaaatctgaactcaaatgaattcacacaccagaaatcttgtaaacatggtacctgtgaccagagcttcaaatggaactcagattttattaaccatcaaataatttatgctggagaaaaaaatcaccaatatggaaaatctttcaagagcccaaaacttgctaaacatgcagcagttttcagtggagataaaactcatcagtgtaatgaatgtgggaaagctttcaggcacagctcaaaacttgctaggcatcagagaatccacactggagagagatgctatgaatgtaatgaatgtgggaaaagctttgcagagagctcagatcttactagacatcggcgaattcacactggggaaagaccctttggttgcaaagaatgtgggagagcattcaacctgaactcacatcttatcaggcatcagagaattcacaccagagagaaaccctacgagtgtagtgaatgtgggaaaaccttccgagtgagctcacatcttattcgacactttagaattcacactggagaaaaaccctatgaatgcagtgagtgtggaagagccttcagtcagagctcaaaccttagtcaacaccagagaattcacatgagggaaaacctattaatgtaaggaacttaaatttgtaagtaaatgctgaggaaatggcacaatatgaaaaatattaaataaaaaataaatattgggcaagatggaagactgaaa

SEQ ID NO: 34908 - DNA, 2319 bp, Homo sapiens
gatttgcctctgcaacttgactctcctctaggaagagtactccagagagcagggatatgtcaccaggactcctgacaaccaggaaggaggcattgatggccttccgggatgtggctgtggccttcacccagaaggagtggaagctattgagttctgctcagaggaccctgtacagggaggtgatgctggagaactacagccatctggtctccctgggaattgcattttccaaaccaaaactcatcgaacagctggagcaaggcgacgaaccttggagagaggagaacgaacatcttctggacctttgtccagctcagacaccaagttcttggctcttgcataaacagcaggccgaacaaatgtttctcaggcaaggtttaataggcttgagctggagcaaaagcaagggagcggcgcccaagaaaggaagataaatgtgtaactctacttgcagcaatttatagagctgaagctgcctgtgatgcttttttgaaccttttagtttggctgataggactagtttgtagtgtgggttttctgtgctgcaatagagcatgtaatgtgcccttgtgggttggaagataagtctttgttgtgaacatctgaagaaaactgctgggcaggtattacaatccatggtcacctgtggtgattctgaccaagactttctctctagcagagcctagaacagaattccagccaagttttccccacctggtggccttttctagctcgcagctcctcagacaatatgcgctaagtggccatcccacacagatcttcccaagctcatctgcaggaggtgacttccaactagaagctccaagatgctctagtgaaaaaggagaaagtggagagacagaaggccccgacagctcattaagaaagaggccaagcagaatttctaggacattcttcagcccacatcaaggtgacccagtagaatgggtagaagggaacagagaaggaggaacagaccttcgcctggcccaaaggatgagtcttggggggtcagacacaatgttgaagggagcagacacttcagaatctggagcagtcatacgtggaaactatagactgggacttagcaaaaagtcaagcctgttcagccaccagaagcatcatgtgtgccctgaatgcgggagaggcttttgccagagatcagaccttatcaagcaccagaggacacacaccggggagaagccatacctgtgtcctgagtgtgggcgtcggtttagccagaaggcctccctctccatacaccagaggaagcactcgggggagaagccgtatgtgtgcagggaatgtgggcgacacttcaggtatacatcctctctcactaatcacaagaggattcactccggggagaggccctttgtatgtcaggagtgtgggcgaggctttcgccagaagatagccctccttctacaccagaggacgcacttggaggagaagcccttcgtgtgtcctgagtgtgggagaggcttttgccagaaggcatcactcctccagcaccagagctcacacacaggggagaggcccttcctgtgccttgagtgtgggcgtagcttcaggcagcagtcactcctccttagtcaccaggtcacacactcaggagagaagccttatgtctgtgctgagtgtgggcacagctttcgccaaaaggtcactctcatcaggcaccagaggacacacacaggggagaagccttacctgtgcccccagtgtgggcggggttttagccagaaggtcaccctcattggacaccagaggacacacacaggggagaagccctacctgtgccctgattgtgggcgtggctttggtcagaaggtcaccctcatcagacaccagaggacacacacaggggagaagccttatctgtgccccaagtgtgggcgtgcatttggctttaagtcgctcctcacccgacaccagaggacacactcagaggaggagctttacgtagacagggtgtgtggacaaggacttggccagaagtcacaccttatctctgaccaaaggacacactcaggagagaagccctgcatttgcgatgaatgtgggcgcggctttggctttaagtctgccctcatccgacatcagcggacccattctggggagaagccgtatgtctgcagggagtgtgggcgtggctttagccagaagtctcacttgcatagacacaggaggaccaagtctggtcatcagctcctaccccaagaggtcttctgacctttcctttccccgtgagtgtgaagctggcagaaatcactagtaaatgcttcagtttcctgaaatggaatggaaaaaaaaaaa

SEQ ID NO: 34909 - DNA, 543 bp, Homo sapiens
atttgcctctgcaacttgactctcctctaggaagagtactccagagagcagggatatgtcaccaggactcctgacaaccaggaaggaggcattgatggccttccgggatgtggctgtggccttcacccagaaggagtggaagctattgagttctgctcagaggaccctgtacagggaggtgatgctggagaactacagccatctggtctccctgggaattgcattttccaaaccaaaactcatcgaacagctggagcaaggcgacgaaccttggagagaggagaacgaacatcttctggacctttgtccaggcaggcggatcacaaggtcaggagttcgagactagtctggccaacatagtgaaaccccatctctactaaaaatacaaaaaaaactagccgagtgtggtggtgcgcacctgtaatcacagctactcgggaggctgaggcaggaggatcgcgtgaactcgggaggcggaggttgcagtgagccgagatcacactattgcactccagcccaggcaacagtgcgagactccatctc

SEQ ID NO: 34910 - DNA, 1986 bp, Homo sapiens
tacttccgcgttccggcatcgtcgcctggtgcgtgatttgcctctgcaacttgactctcctctaggaagagtactccagagagcagggatatgtcaccaggactcctgacaaccaggaaggaggcattgatggccttccgggatgtggctgtggccttcacccagaaggagtggaagctattgagttctgctcagaggaccctgtacagggaggtgatgctggagaactacagccatctggtctccctgggaattgcattttccaaaccaaaactcatcgaacagctggagcaaggcgacgaaccttggagagaggagaacgaacatcttctggacctttgtccagagcctagaacagaattccagccaagttttccccacctggtggccttttctagctcgcagctcctcagacaatatgcgctaagtggccatcccacacagatcttcccaagctcatctgcaggaggtgacttccaactagaagctccaagatgctctagtgaaaaaggagaaagtggagagacagaaggccccgacagctcattaagaaagaggccaagcagaatttctaggacattcttcagcccacatcaaggtgacccagtagaatgggtagaagggaacagagaaggaggaacagaccttcgcctggcccaaaggatgagtcttggggggtcagacacaatgttgaagggagcagacacttcagaatctggagcagtcatacgtggaaactatagactgggacttagcaaaaagtcaagcctgttcagccaccagaagcatcatgtgtgccctgaatgcgggagaggcttttgccagagatcagaccttatcaagcaccagaggacacacaccggggagaagccatacctgtgtcctgagtgtgggcgtcggtttagccagaaggcctccctctccatacaccagaggaagcactcgggggagaagccgtatgtgtgcagggaatgtgggcgacacttcaggtatacatcctctctcactaatcacaagaggattcactccggggagaggccctttgtatgtcaggagtgtgggcgaggctttcgccagaagatagccctccttctacaccagaggacgcacttggaggagaagcccttcgtgtgtcctgagtgtgggagaggcttttgccagaaggcatcactcctccagcaccagagctcacacacaggggagaggcccttcctgtgccttgagtgtgggcgtagcttcaggcagcagtcactcctccttagtcaccaggtcacacactcaggagagaagccttatgtctgtgctgagtgtgggcacagctttcgccaaaaggtcactctcatcaggcaccagaggacacacacaggggagaagccttacctgtgcccccagtgtgggcggggttttagccagaaggtcaccctcattggacaccagaggacacacacaggggagaagccctacctgtgccctgattgtgggcgtggctttggtcagaaggtcaccctcatcagacaccagaggacacacacaggggagaagccttatctgtgccccaagtgtgggcgtgcatttggctttaagtcgctcctcacccgacaccagaggacacactcagaggaggagctttacgtagacagggtgtgtggacaaggacttggccagaagtcacaccttatctctgaccaaaggacacactcaggagagaagccctgcatttgcgatgaatgtgggcgcggctttggctttaagtctgccctcatccgacatcagcggacccattctggggagaagccgtatgtctgcagggagtgtgggcgtggctttagccagaagtctcacttgcatagacacaggaggaccaagtctggtcatcagctcctaccccaagaggtcttctgacctttcctttccccgtgagtgtgaagctggcagaaatcactagtaaatgcttcagtttcctgaaatggaatggaaaaaaaaaaa

SEQ ID NO: 34911 - DNA, 2260 bp, Homo sapiens
ccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttacttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgaagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccagaatttcaa

SEQ ID NO: 34912 - DNA, 1574 bp, Homo sapiens
agcgagtggcatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaacttcttatagaaaagacagatccaaatatggccacagatgaacttccatgcaagctatggctgagtttcattgcttaaaatgctcctctgtttagaggggcctggtagaaataaaaacccaccctatatctt

SEQ ID NO: 34913 - DNA, 3742 bp, Homo sapiens
gttgttaagtggatctaagcctatgtcgcttactggacgctgaagtgattgggaatattagcagtgggggttctgtagggtcaggaaggggcggctggctttgggggagtgatgaggggcttgttgggggtgggggtgcgtgataaagggatttctcggctgaagacgaggctgtgaggcttctgcagaacccccaggtcaggccacatcattgaggctgcaggatctctcttcatagcccagtacgactctccgccgtgtccctggttggaaaatccaaacacctatccagcttctggctcctgggaaaagtggagttgtcagcaagagagaccgagagtagaagcccagagtggagatgcctgctgatgtgaatttatcccagaagcctcaggtcctgggtccagagaagcaggatggatcttgcgaggcatcagtgtcatttgaggacgtgaccgtggacttcagcagggaggagtggcagcaactggaccctgcccagagatgcctgtaccgggatgtgatgctggagctctatagccatctcttcgcagtggggtatcacattcccaacccagaggtcatcttcagaatgctaaaagaaaaggagccgcgtgtggaggaggctgaagtctcacatcagaggtgtcaagaaagggagtttgggcttgaaatcccacaaaaggagatttctaagaaagcttcatttcaaaaggatatggtaggtgagttcacaagagatggttcatggtgttccattttagaagaactgaggctggatgctgaccgcacaaagaaagatgagcaaaatcaaattcaacccatgagtcacagtgctttcttcaacaagaaaacattgaacacagaaagcaattgtgaatataaggaccctgggaaaatgattcgcacgaggccccaccttgcttcttcacagaaacaacctcagaaatgttgcttatttacagaaagtttgaagctgaacctagaagtgaacggtcagaatgaaagcaatgacacagaacagcttgatgacgttgttgggtctggtcagctattcagccatagctcttctgatgcctgcagcaagaatattcatacaggagagacattttgcaaaggtaaccagtgtagaaaagtctgtggccataaacagtcactcaagcaacatcaaattcatactcagaagaaaccagatggatgttctgaatgtggggggagcttcacccagaagtcacacctctttgcccaacagagaattcatagtgtaggaaacctccatgaatgtggcaaatgtggaaaagccttcatgccacaactaaaactcagtgtatatctgacagatcatacaggtgatataccctgtatatgcaaggaatgtgggaaggtctttattcagagatcagaattgcttacgcaccagaaaacacacactagaaagaagccctataaatgccatgactgtggaaaagcctttttccagatgttatctctcttcagacatcagagaactcacagtagagaaaaactctatgaatgcagtgaatgtggcaaaggcttctcccaaaactcaaccctcattatacatcagaaaattcatactggtgagagacagtatgcatgcagtgaatgtgggaaagcctttacccagaagtcaacactcagcttgcaccagagaatccactcagggcagaagtcctatgtgtgtatcgaatgcgggcaggccttcatccagaaggcacacctgattgtccatcaaagaagccacacaggagaaaaaccttatcagtgccacaactgtgggaaatccttcatttccaagtcacagcttgatatacatcatcgaattcatacaggggagaaaccttatgaatgcagtgactgtggaaaaaccttcacccaaaagtcacacctgaatatacaccagaaaattcatactggagaaagacaccatgtatgcagtgaatgcgggaaagccttcaaccagaagtcaatactcagcatgcatcagagaattcacaccggagagaagccttacaaatgcagtgaatgtgggaaagccttcacttctaagtctcaattcaaagagcatcagcgaattcacacgggtgagaaaccctatgtgtgcactgaatgtgggaaggccttcaacggcaggtcaaatttccataaacatcaaataactcacactagagagaggccttttgtctgttacaaatgtgggaaggcttttgtccagaaatcagagttgattacccatcaaagaactcacatgggagagaaaccctatgaatgccttgactgtgggaaatcgttcagtaagaaaccacaactcaaggtgcatcagcgaattcacacgggagaaagaccttatgtgtgttctgaatgtggaaaggccttcaacaacaggtcaaacttcaataaacaccaaacaactcataccagagacaaatcttacaaatgcagttattctgtgaaaggctttaccaagcaatgaattcctagtgcatcagcatattcataaatgaaatatactccgagtttcttgaagaagagaaaatcttctcagaatcaggtctaattatatgttattgaattcatgcttcagaaaaactctagggatgcactgcatgtgtgaacacatgataaaaaagtcatgctttattttagtgagggcaattacagagaaaagagtaagcagaaatgtccttctgagtactggcctcattaaggattataaattttctccccgggaagaaaccctgactaacgcattgagaaaagcctttctgtaaagaatggtacaagacaggttgttactcgattatttatagtaaaatatgtgggaaattatatcaatgataaccctgtttattgtgggatatcaatatttttaaagtgccaacacagtcatgataggacaatattttatgtgtgtgtgtgcgccttatgtatataagcatatatataatatataagcatattattatatacaggttgagtatcccttctccaaaatgcctgggatcagaagcattttggatttcagatacttacagattttggaatatttgcattatatttattggttgagcatccctaatctgaaaatccaagattaaatgctccaattagcatttcctttgagcgtcatgttagagttcaaaaagtttcagattttgggttttcagattaggaatacccaacctgtatgtacgtatatttctgtatctatgtatgtatatatatgcatatgcagacatatgtatatggtctggtcagcatatgtgtatgtatgcgtatgtatgtatgtatgtatgccctcagtgcagtggggtttgctgcagaattcactgcatagcaggagatgtaagcagatgagttattttttaagagaatctaatctaattgtttttataaaaattattccctattgaatatttatataatgaggttgtatcaacaatgattaactcctttattatacatacacatgaatgtgcatttttggtaaatgcataaatgagattctataatgtttactgatctttatattacagattttctcttcttttaggattagctcagcttgccccccctttccatctccaccatctatagtgagcctctccataattagtgccaaccattagtctcgttcatatttttacaccaggagtcaacaaactgtggccattggccaaatatggcctcccaactgtttttttaaaataaagttttattg

SEQ ID NO: 34914 - DNA, 2260 bp, Homo sapiens
cgccatctcccatagctgtcgcctgcagctgagaaagggttgctgtcccagcaggccaggtccagggctgggtataagtaagcaagaagagggcctgggagaagagtctgacgagcaaggggaaggtagccaaggatggagtgaaatacagggtgacctgtgtttttcccctggctgctttggaaattatgggaaaaaatcaaataccaaggaagaaaaatctataatgaaattagatgtggatttctttttatgtattcagcttgggggcttatgatacttctagtacccaaagagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacgaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttcaagctggcaatgtggacagttttcacccagcttcccttacagctgtgagcggccaaatatgttcacatccctagcccatgcaaagtaggcagaagtcactggatacagctgctaaggaagctcatggaaatgggaatatctcatctggtgtttttttcttaactatttgccctttgtcttgtcccttatttcctagaaaatatatacaccaagaggaggacagagaaaggatactaaatgaaacaacaggggagatacaatattatctggttgcactaatcctgtgctgcttatctctggatttcatgttacatgagaaaaattaactgccatgtggtttaaaccactcttgtgggaagttcctctttcagctgatttcagtcccaactgttacatctaataaatggtcaagttttaggaatcgttc

SEQ ID NO: 34915 - DNA, 2340 bp, Homo sapiens
tagctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacggcagaaaatcaacctggtgagcactccctggagtgtaaccattgtgggaaattcagaaagaacactcgctttatttgtacaagatattgcaagggagagaaatgctataaatatataaagtatagcaaagtcttcaaccatccctcaactcttaggagtcatgtgagcattcacattggagagaaaactcttgaatttactgattgtagaaaagctttcaatcaagagtcatccctcaggaaacacttaagaactcccacaggacagaagtttcaggagtatgagcaatgtgatatgtccttcagcctacactcttcctgctcagtacgtgagcaaatacctactggagagaaaggtgatgaatgcagtgactatggcaaaatatctccccttagtgtccacacaaaaactggtagtgtggaggagggtttggaatgtaatgaacatgagaaaactttcactgaccctttgtcccttcagaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttcaagctggcaatgtggacagttttcacccagcttcccttacagctgtgagcggccaaatatgttcacatccctagcccatgcaaagtaggcagaagtcactggatacagctgctaaggaagctcatggaaatgggaatatctcatctggtgtttttttcttaactatttgccctttgtcttgtcccttatttcctagaaaatatatacaccaagaggaggacagagaaaggatactaaatgaaacaacaggggagatacaatattatctggttgcactaatcctgtgctgcttatctctggatttcatgttacatgagaaaaattaactgccatgtggtttaaaccactcttgtgggaagttcctctttcagctgatttcagtcccaactgttacatctaataaatggtcaagttttaggaatcgttc

SEQ ID NO: 34916 - DNA, 2383 bp, Homo sapiens
gaccttcgcttggtgtcctcctggcctcagcaacctgacaattctgtcgtgtcccgggctgggtataagtaagcaagaagagggcctgggagaagagtctgacgagcaaggggaaggtagccaaggatggagtgaaatacagggtgacctgtgtttttcccctggctgctttggaaattatgggaaaaaatcaaataccaaggaagaaaaatctataatgaaattagatgtggatttctttttatgtattcagcttgggggcttatgatacttctagtacccaaagagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacgaatcctcatggaagagaattcctgtgaataaggtgaaagtgaaaaagcctctagtcaccacttactcccttttcaacaggcagaaaatcaacctggtgagcactccctggagtgtaaccattgtgggaaattcagaaagaacactcgctttatttgtacaagatattgcaagggagagaaatgctataaatatataaagtatagcaaagtcttcaaccatccctcaactcttaggagtcatgtgagcattcacattggagagaaaactcttgaatttactgattgtagaaaagctttcaatcaagagtcatccctcaggaaacacttaagaactcccacaggacagaagtttcaggagtatgagcaatgtgatatgtccttcagcctacactcttcctgctcagtacgtgagcaaatacctactggagagaaaggtgatgaatgcagtgactatggcaaaatatctccccttagtgtccacacaaaaactggtagtgtggaggagggtttggaatgtaatgaacatgagaaaactttcactgaccctttgtcccttcagaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttc

SEQ ID NO: 34917 - DNA, 2429 bp, Homo sapiens
atttcgagcatcttgtgggctctcccaagtcgcggcccctcctctgagagccacagtcaggaacagcatctctgccttcctgttcacggtgaccttcgcttggtgtcctcctggcctcagcaacctgacaattctgtcgtgtcccgatcatctttctcaagatgttttctgtcttcatgagtcaaaatttgaagaggaaaggatggtggctgggtggttgacaaattactctcagttgctttgattagaaagtttggctttgctgagatacgtagttggaaaagagagaagcattttcagtttcttcagtgtactagatggctgactgggaagattccagggtcccaacaggcttcagagttgcgaaggctctagagggctgggtataagtaagcaagaagagggcctgggagaagagtctgacgagcaaggggaaggtagccaaggatggagtgaaatacaggagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacgaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttcaagctggcaatgtggacagttttcacccagcttcccttacagctgtgagcggccaaatatgttcacatccctagcccatgcaaagtaggcagaagtcactggatacagctgctaaggaagctcatggaaatgggaatatctcatctggtgtttttttcttaactatttgccctttgtcttgtcccttatttcctagaaaatatatacaccaagaggaggacagagaaaggatactaaatgaaacaacaggggagatacaatattatctggttgcactaatcctgtgctgcttatctctggatttcatgttacatgagaaaaattaactgccatgtggtttaaaccactcttgtgggaagttcctctttcagctgatttcagtcccaactgttacatctaataaatggtcaagttttaggaatcgttc

SEQ ID NO: 34918 - DNA, 2767 bp, Homo sapiens
atctgcgtccgcacctgactcagctgggcaccccggagctacggaggggccagcgggctcccttgcccatgcgtctgggagcgcgcgggggacgtggcgaggctgaaaatgagtctctggaagaggaaacccgatgggatgatgcctggagtctctccctctctcatcagagtgcagtcggcatttggggggcgcatggtggagaatacatatccaatgagcagcgctgccctggcctcgagcactaaatgccagttcccctagctgcttgtgacaaccagaaaacgccccaacaaatcaccagacgttggcagttctccccaaagcaaaggctttagagcttcctgggttaatctggctgccacttgtgagcctcggaggttcctgatctgtacaccaggatggagtctccctctgtcgcccaggctggagtgcagtggtacgatcttgactcactgcaacttccgcctcccaggttcaggctgttctcctacctcagcctcctgagttgctgggattacagtgtcctggtgaagacctagttcttgccggagacaattccactgcagaagcactttacttaaaaggacttgccaggctggacaatgcccgttgacttggggcaggccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctcatgagaccttgaagcaacttcggaagctctgtttccagtggctacagccagaggttcacaccaaagagcagatcctagagatcctcatgttggagcagtttctgaccatcctgcctggggagatccagatgtgggtgcggaaacagtgtccaggaagtggagaagaggcagtgacccttgtggaaagcttgaagggggacccccagagactgtggcaatggatcagtatccaggttctaggacaggacatcttatcagagaagatggaatctccaagctgccaagtgggggaagtggagccccatcttgaagtggtgcctcaggagttgggacttgagaattcatcctcagggcctggggagcttctgagccacatcgtgaaagaggaatctgacacagaagcagaactagccctggctgcctcccagcctgcccgactggaggaaaggctgatcagagaccaggacctcggagcctcactgctcccagcagcacctcaggaacagtggagacaactggattccactcaaaaggagcaatactgggatctcatgctggagacctatgggaaaatggtctcaggagcaggcatttcccatcccaaatctgacctgactaattcaatagaatttggggaagagctggcaggaatataccttcatgtcaatgagaagatcccaagacccacctgcataggagatagacaagagaatgacaaggagaacctaaatttggagaatcacagggaccaggagctcctgcatgcttcctgtcaagcttcaggagaggttccttctcaggcttccttgaggggcttcttcactgaggatgagccaggatgctttggagaaggagagaatctccctgaggctctgcaaaacattcaggatgagggaacaggggaacagctgtctcctcaagaaaggatttctgagaaacaactaggtcagcatttgcctaatcctcattcaggagaaatgtccaccatgtggcttgaggagaagagagagacctcccagaaggggcagccaagagcccccatggcccagaagctccccacctgcagggagtgtgggaagaccttttataggaattctcagcttatttttcaccaaagaactcacaccggagagacatactttcagtgcaccatctgcaaaaaagcctttctgcggagttcagactttgtgaagcatcagagaactcacacgggagagaagccctgtaaatgtgattactgtgggaaaggctttagtgacttctcaggattgcgccaccacgagaaaatccacacaggagagaaaccctataaatgtcctatctgtgagaaaagtttcattcagagatcaaactttaatagacatcagagggttcacactggagagaaaccttataaatgttcgcactgtgggaaaagtttcagctggagctcgagccttgacaaacatcaaagatcccacttaggaaagaagccctttcaatagccagtaaccaaactctctttccccatttctatctcccagcccagtcacaaaaatactcagctccatcaagaggaattgtgtctaagaggatacccctgttaatctccttttttcttggattggagaggagagaatctggacatggctttggacttggaggatatcttggattggattgcacaatggcttaaattcttgattctgcctcaggagaaagaatagtcttcatgtttccactcatccttcctttggacccatcggggaaaaagtctaaattggagatccagttttagaagtgctttctgggaagcatttaatgggattagctgtagtcactgcttatgggaagaacctcagatcagccccttaaaatgagttctagagcaggtcttctgttccagaaggggagaagcatagagggcctgtgagctcacgtgtgttctttgtcataggggtgaaaaactaacttcaagtgtcccttgtttgaaataaacttagcagagtcactttct

SEQ ID NO: 34919 - DNA, 2282 bp, Homo sapiens
tcccggaagtgcgcccggagccggcgccgcgggccgagtgtcctggtgaagacctagttcttgccggagacaattccactgcagaagcactttacttaaaaggacttgccaggctggacaatgcccgttgacttggggcaggccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctcatgagaccttgaagcaacttcggaagctctgtttccagtggctacagccagaggttcacaccaaagagcagatcctagagatcctcatgttggagcagtttctgaccatcctgcctggggagatccagatgtgggtgcggaaacagtgtccaggaagtggagaagaggcagtgacccttgtggaaagcttgaagggggacccccagagactgtggcaatggatcagtatccaggttctaggacaggacatcttatcagagaagatggaatctccaagctgccaagtgggggaagtggagccccatcttgaagtggtgcctcaggagttgggacttgagaattcatcctcagggcctggggagcttctgagccacatcgtgaaagaggaatctgacacagaagcagaactagccctggctgcctcccagcctgcccgactggaggaaaggctgatcagagaccaggacctcggagcctcactgctcccagcagcacctcaggaacagtggagacaactggattccactcaaaaggagcaatactgggatctcatgctggagacctatgggaaaatggtctcaggagcaggcatttcccatcccaaatctgacctgactaattcaatagaatttggggaagagctggcaggaatataccttcatgtcaatgagaagatcccaagacccacctgcataggagatagacaagagaatgacaaggagaacctaaatttggagaatcacagggaccaggagctcctgcatgcttcctgtcaagcttcaggagaggttccttctcaggcttccttgaggggcttcttcactgaggatgagccaggatgctttggagaaggagagaatctccctgaggctctgcaaaacattcaggatgagggaacaggggaacagctgtctcctcaagaaaggatttctgagaaacaactaggtcagcatttgcctaatcctcattcaggagaaatgtccaccatgtggcttgaggagaagagagagacctcccagaaggggcagccaagagcccccatggcccagaagctccccacctgcagggagtgtgggaagaccttttataggaattctcagcttatttttcaccaaagaactcacaccggagagacatactttcagtgcaccatctgcaaaaaagcctttctgcggagttcagactttgtgaagcatcagagaactcacacgggagagaagccctgtaaatgtgattactgtgggaaaggctttagtgacttctcaggattgcgccaccacgagaaaatccacacaggagagaaaccctataaatgtcctatctgtgagaaaagtttcattcagagatcaaactttaatagacatcagagggttcacactggagagaaaccttataaatgttcgcactgtgggaaaagtttcagctggagctcgagccttgacaaacatcaaagatcccacttaggaaagaagccctttcaatagccagtaaccaaactctctttccccatttctatctcccagcccagtcacaaaaatactcagctccatcaagaggaattgtgtctaagaggatacccctgttaatctccttttttcttggattggagaggagagaatctggacatggctttggacttggaggatatcttggattggattgcacaatggcttaaattcttgattctgcctcaggagaaagaatagtcttcatgtttccactcatccttcctttggacccatcggggaaaaagtctaaattggagatccagttttagaagtgctttctgggaagcatttaatgggattagctgtagtcactgcttatgggaagaacctcagatcagccccttaaaatgagttctagagcaggtcttctgttccagaaggggagaagcatagagggcctgtgagctcacgtgtgttctttgtcataggggtgaaaaactaacttcaagtgtcccttgtttgaaataaacttagcagagtcactttct

SEQ ID NO: 34920 - DNA, 3119 bp, Homo sapiens
acaagagcagccattgtcccgcgcgcggacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccaggttggtaggggcgtggggcagcgcttggtgtccgatgcgcgcatgcgcagggtctacgcgggaagctggaagcggtgctcaggacctcagcaccctgctgtgcctggaggagagcatggaagagcaggatgagaagcccccagagcccccgaaggcctgtgcacaggattctttccttcctcaagagattatcatcaaagtcgagggagaagacactgggtctctgaccatcccatctcaggaaggagtgaacttcaaaattgtgactgtggacttcacacgggaggaacagggtacttggaaccctgctcagaggaccctggacagagatgtgatcctggagaaccacagggacctagtctcttgggacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttatacccataagaaaccattttcataaacatgtatcacatgctaaaaaatggcatcttaatgctgctgtaaacagtcatcagaagattaatgagaatgagacactatatgaaaataatgaatgtggaaaaccccctcagagcattcaccttattcagtttacaagaactcaaacaaaagataaatgctatggatttagtgaccgtattcaatctttttgccatggtacacccctacatatacatgaaaaaattcatggaggaggaaaaacctttgattttaaagaatgtgggcaggttttgaaccccaaaatatcccataatgaacaacagagaattccttttgaagagagtcaatataaatgtagtgaaacctctcatagttcctcccttactcaaaacatgagaaataattctgaagagaaaccttttgaatgtaatcagtgtgggaaatccttcagctggagctcgcatcttgttgcacatcagagaactcacacaggggagaaaccttatgaatgtagtgaatgtggaaaatccttcagccggagctcgcaccttgtttcccatcagagaactcatactggagagaaaccttacaggtgtaatcaatgtgggaaatcctttagccagagttatgtccttgttgtgcatcaaagaactcatactggggagaagccttatgaatgcaatcaatgtggaaagtcattcaggcagagctataaacttattgcacatcaaagaacacataccggagagaagccctatgaatgtaatcaatgtgggaaatcatttatccagagctataaacttattgcacatcaaagaattcatactggggaaaaaccctatgaatgcaatcagtgtgggaaatcctttagtcaaagttataaacttgttgctcatcagagaactcacacaggagaaaaaccctttgaatgtaatcagtgtgggaaatccttcagctggagctctcagcttgttgcacatcaaagaactcacactggagagaaaccgtatgaatgtagtgaatgtggaaaatcttttaaccgcagttctcaccttgttatgcatcagagaattcacactggggaaaaaccgtatgaatgtaatcagtgtgggaaatccttcagccagagttatgttcttgttgtacatcagagaactcatactggagaaaagccctatgaatgcagtcaatgtgggaagtccttcagacagagttcatgccttactcaacatcagagaactcatactggagagaaaccatttgaatgtaatcagtgtggaaaaacatttagcttgagtgctcgacttattgtgcatcaaagaactcatactggagagaaaccctttacatgtattcagtgtggaaaagctttcattaatagctataaacttattaggcatcaggcaactcatactgaagagaaactctatgaatgtaactagtttgtaaatcagctgggatttcttcctttttatttcattcttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaatactggcacttttccttgcagaaagcactcagacctgaatcagagaaaatcatatgccaaagccaactgccagtgttagacctctttttccataaagagtaaatggaatgctaacactagtgggcttattgagaaaatttaaaggttgctgtagtgtttagaacttaggctggaaaaccatattttagtgcatcattttactacatgatcttccaattagatagcttgtaatctgttccttacagcacttgctgttgttacatgtgaagattttataaattttaggaaagtgtctatgatatatagtgaaaagtgtgggaaaagaatatagaaataatattcacttctaaaaccattatgataaaatatttgtgtatggattagaatagaaagggattatggatgtatctattcaatttctcagtttatgttgggccttcctttttggaatgtacgctgttatgctatgataaatgatataatgagtaaaaattattcaaagcc

SEQ ID NO: 34921 - DNA, 3042 bp, Homo sapiens
aagagcagccattgtcccgcgcgcggacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccaggttggtaggggcgtggggcagcgcttggtgtccgatgcgcgcatgcgcagggtctacgcgggaagctggaagcggtgctcaggacctcagcaccctgctgtgcctggaggagagcatggaagagcaggatgagaagcccccagagcccccgaaggcctgtgcacaggaaggagtgaacttcaaaattgtgactgtggacttcacacgggaggaacagggtacttggaaccctgctcagaggaccctggacagagatgtgatcctggagaaccacagggacctagtctcttgggacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttatacccataagaaaccattttcataaacatgtatcacatgctaaaaaatggcatcttaatgctgctgtaaacagtcatcagaagattaatgagaatgagacactatatgaaaataatgaatgtggaaaaccccctcagagcattcaccttattcagtttacaagaactcaaacaaaagataaatgctatggatttagtgaccgtattcaatctttttgccatggtacacccctacatatacatgaaaaaattcatggaggaggaaaaacctttgattttaaagaatgtgggcaggttttgaaccccaaaatatcccataatgaacaacagagaattccttttgaagagagtcaatataaatgtagtgaaacctctcatagttcctcccttactcaaaacatgagaaataattctgaagagaaaccttttgaatgtaatcagtgtgggaaatccttcagctggagctcgcatcttgttgcacatcagagaactcacacaggggagaaaccttatgaatgtagtgaatgtggaaaatccttcagccggagctcgcaccttgtttcccatcagagaactcatactggagagaaaccttacaggtgtaatcaatgtgggaaatcctttagccagagttatgtccttgttgtgcatcaaagaactcatactggggagaagccttatgaatgcaatcaatgtggaaagtcattcaggcagagctataaacttattgcacatcaaagaacacataccggagagaagccctatgaatgtaatcaatgtgggaaatcatttatccagagctataaacttattgcacatcaaagaattcatactggggaaaaaccctatgaatgcaatcagtgtgggaaatcctttagtcaaagttataaacttgttgctcatcagagaactcacacaggagaaaaaccctttgaatgtaatcagtgtgggaaatccttcagctggagctctcagcttgttgcacatcaaagaactcacactggagagaaaccgtatgaatgtagtgaatgtggaaaatcttttaaccgcagttctcaccttgttatgcatcagagaattcacactggggaaaaaccgtatgaatgtaatcagtgtgggaaatccttcagccagagttatgttcttgttgtacatcagagaactcatactggagaaaagccctatgaatgcagtcaatgtgggaagtccttcagacagagttcatgccttactcaacatcagagaactcatactggagagaaaccatttgaatgtaatcagtgtggaaaaacatttagcttgagtgctcgacttattgtgcatcaaagaactcatactggagagaaaccctttacatgtattcagtgtggaaaagctttcattaatagctataaacttattaggcatcaggcaactcatactgaagagaaactctatgaatgtaactagtttgtaaatcagctgggatttcttcctttttatttcattcttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaatactggcacttttccttgcagaaagcactcagacctgaatcagagaaaatcatatgccaaagccaactgccagtgttagacctctttttccataaagagtaaatggaatgctaacactagtgggcttattgagaaaatttaaaggttgctgtagtgtttagaacttaggctggaaaaccatattttagtgcatcattttactacatgatcttccaattagatagcttgtaatctgttccttacagcacttgctgttgttacatgtgaagattttataaattttaggaaagtgtctatgatatatagtgaaaagtgtgggaaaagaatatagaaataatattcacttctaaaaccattatgataaaatatttgtgtatggattagaatagaaagggattatggatgtatctattcaatttctcagtttatgttgggccttcctttttggaatgtacgctgttatgctatgataaatgatataatgagtaaaaattattcaaagcc

SEQ ID NO: 34922 - DNA, 2791 bp, Homo sapiens
cggttcgttgcgcctggaattttgtcccctgcgcggatgattctgggaaatgtcgatcggctgtgggcggcgcactgggtccgccccgctgtagcctcaggacactgcccatctctaagataagagcctggaaagaggactctgttggctgttggaaattgcagagtaatgcctcagcttcagtacccagagggttacctggcaccaaatagatgcttagtaagtaattgtggagtgaataagatgagtaatgacgaactggtggggcagaatcatggcatggaaggtgaagcttgcataggaggggatgtgacatttaatgatgtggctatagacttcactcatgaagagtggggatggctcagttctgctcagagggacttatacaaggatgtgatggtccagaattatgagaacctggtctctgtagcaggtctttctgtaactaagccatatgtgatcacgttattggaggatggaaaagagccctggatgatggagaaaaaactgtcaaaaggtatgattccagattgggaatcaagatgggaaaacaaggaattatcaacaaagaaggataattatgatgaagattcaccccaaacagtaataatagaaaaagttgtaaaacaaagttatgaattttcaaattctaagaagaatttggaatatatagagaagttggaagggaagcatggaagtcaggtagaccatttcagaccagcaattctcacctctagagaaagccccactgcagacagtgtttacaaatacaatatatttagaagcacctttcattcaaagtctactctttctgaaccacaaaaaatttctgctgaagggaattcacacaaatatgatatattaaagaagaacttaccaaaaaagtcagttataaaaaatgagaaagtcaatggtggaaagaaacttttgaattctaataaaagtggggcagccttcagccagggcaaatctcttacccttccccagacttgtaatagagagaaaatctatacatgcagtgaatgtgggaaagcctttggcaaacagtcaatcctcaatcgccactggagaattcatacaggagagaagccctatgaatgtcgtgaatgtgggaagacttttagccatggctcatcccttacacgacatctgataagccatagtggagagaaaccttacaaatgtattgaatgtgggaaggcctttagccatgtctcatcacttactaaccatcagagcactcacactggagagaaaccatatgaatgtatgaactgtggaaagtcttttagtcgtgtgtcccatcttattgaacatctaagaattcatactcaagaaaaactctatgagtgtcgtatatgtggaaaggccttcattcataggtcatctctcattcaccatcagaaaatccatactggagagaagccttatgaatgtagagaatgtgggaaagctttctgctgtagctcacaccttactcgacatcaaagaattcacactatggagaaacaatatgaatgcaacaaatgtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattagattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttaccgtacatcagagaattcacactggagaaaagccatataaatgtaatgagtgtgggaaagcttttagcaaaggctcaaatcttactgcccatcaaagagtacataatggagagaaacccaatagtgtggtaagtgtggaaaagcctttagactatatgaatcactatacatgtgagaaatcttacagaagagaaactgtatgaagcagtggttatcatggtaaatttcctagattctcccttatttaacattagaaaaatttatactggggaaagtcttatgaatgtggtgaatataggaagaccttttagcaaagatgcaggccagtttgtttattagactttatactgtagagaaatcatatgaagaccataaatgtgggaaagcctttgtcagtattaatcccttaattgacataagtatactcacactaggataaaaccctgtacatgtagcaaatgtgggaaagactacagacaataggaatcttttacaaactcctacaggagagaagctgtatgaatgtagaaaatttagaaattgagggaagtcttcagttccaagtatatcccttattctacagcagagaactcaaaatggagagaaatctcatttaagagatgtagcaaagtgttcactaagagtgtttatcttggtacacatcagaagattaatggtagaacaacctgaaggatttaggagttatgtgtaaatctttgcagtcatgctatttgtaaactggattctacaggagagcaaataaacattataataaaatatgcatttcttagagcagtagcttgcagtttcagttgagttctacttagaaattctttttagctagtgggcatgtgaagatatttagtcacccagaggagccagtaagtgttataatattgaaaattaaagctgcaaaagaaataaagtgatgttaataaaagttttggcatctaataaaatcattttgtatatcacaaa

SEQ ID NO: 34923 - DNA, 1776 bp, Homo sapiens
gtagcctcaggcctgacggcgactcccaggctccgggacgattctgggcagtgtcgtccccagaggacactgcccatctctaagataagagcctggaaagaggactctgttggctgttggaaattgcagagtaatgcctcaggtgacatttaatgatgtggctatagacttcactcatgaagagtggggatggctcagttctgctcagagggacttatacaaggatgtgatggtccagaattatgagaacctggtctctgtaggtctttctgtaactaagccatatgtgatcacgttattggaggatggaaaagagccctggatgatggagaaaaaactgtcaaaaggtatgattccagattgggaatcaagatgggaaaacaaggaattatcaacaaagaaggataattatgatgaagattcaccccaaacagtaataatagaaaaagttgtaaaacaaagttatgaattttcaaattctaagaagaatttggaatatatagagaagttggaagggaagcatggaagtcaggtagaccatttcagaccagcaattctcacctctagagaaagccccactgcagacagtgtttacaaatacaatatatttagaagcacctttcattcaaagtctactctttctgaaccacaaaaaatttctgctgaagggaattcacacaaatatgatatattaaagaagaacttaccaaaaaagtcagttataaaaaatgagaaagtcaatggtggaaagaaacttttgaattctaataaaagtggggcagccttcagccagggcaaatctcttacccttccccagacttgtaatagagagaaaatctatacatgcagtgaatgtgggaaagcctttggcaaacagtcaatcctcaatcgccactggagaattcatacaggagagaagccctatgaatgtcgtgaatgtgggaagacttttagccatggctcatcccttacacgacatctgataagccatagtggagagaaaccttacaaatgtattgaatgtgggaaggcctttagccatgtctcatcacttactaaccatcagagcactcacactggagagaaaccatatgaatgtatgaactgtggaaagtcttttagtcgtgtgtcccatcttattgaacatctaagaattcatactcaagaaaaactctatgagtgtcgtatatgtggaaaggccttcattcataggtcatctctcattcaccatcagaaaatccatactggagagaagccttatgaatgtagagaatgtgggaaagctttctgctgtagctcacaccttactcgacatcaaagaattcacactatggagaaacaatatgaatgcaacaaatgtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttaccgtacatcagagaattcacactggagaaaagccatataaatgtaatgagtgtgggaaagcttttagcaaaggctcaaatcttactgcccatcaaagagtacataatggagagaaacccaatagtgtggtaagtgtgg

SEQ ID NO: 34924 - DNA, 1891 bp, Homo sapiens
cctgcccttctgtgccctcaggacactgcccatctctaagataagagcctggaaagaggactctgttggctgttggaaattgcagagtaatgcctcaggtgacatttaatgatgtggctatagacttcactcatgaagagtggggatggctcagttctgctcagagggacttatacaaggatgtgatggtccagaattatgagaacctggtctctgtaggtctttctgtaactaagccatatgtgatcacgttattggaggatggaaaagagccctggatgatggagaaaaaactgtcaaaaggtatgattccagattgggaatcaagatgggaaaacaaggaattatcaacaaagaaggataattatgatgaagattcaccccaaacagtaataatagaaaaagttgtaaaacaaagttatgaattttcaaattctaagaagaatttggaatatatagagaagttggaagggaagcatggaagtcaggtagaccatttcagaccagcaattctcacctctagagaaagccccactgcagacagtgtttacaaatacaatatatttagaagcacctttcattcaaagtctactctttctgaaccacaaaaaatttctgctgaagggaattcacacaaatatgatatattaaagaagaacttaccaaaaaagtcagttataaaaaatgagaaagtcaatggtggaaagaaacttttgaattctaataaaagtggggcagccttcagccagggcaaatctcttacccttccccagacttgtaatagagagaaaatctatacatgcagtgaatgtgggaaagcctttggcaaacagtcaatcctcaatcgccactggagaattcatacaggagagaagccctatgaatgtcgtgaatgtgggaagacttttagccatggctcatcccttacacgacatctgataagccatagtggagagaaaccttacaaatgtattgaatgtgggaaggcctttagccatgtctcatcacttactaaccatcagagcactcacactggagagaaaccatatgaatgtatgaactgtggaaagtcttttagtcgtgtgtcccatcttattgaacatctaagaattcatactcaagaaaaactctatgagtgtcgtatatgtggaaaggccttcattcataggtcatctctcattcaccatcagaaaatccatactggagagaagccttatgaatgtagagaatgtgggaaagctttctgctgtagctcacaccttactcgacatcaaagaattcacactatggagaaacaatatgaatgcaacaaatgtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattagattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttaccgtacatcagagaattcacactggagaaaagccatataaatgtaatgagtgtgggaaagcttttagcaaaggctcaaatcttactgcccatcaaagagtacataatggagagaaacccaatagtgtggtaagtgtggaaaagcctttagactatatgaatcactatacatgtgagaaatcttacagaagagaaactgtatgaagcagtggttatcatggtaaatttcctagattctcccttatttaacattagaaaaatttatactggggaaagtcttatgaatgtggtga

SEQ ID NO: 34925 - DNA, 1894 bp, Homo sapiens
cctgcccttctgtgccctcaggacactgcccatctctaagataagagcctggaaagaggactctgttggctgttggaaattgcagagtaatgcctcaggtgacatttaatgatgtggctatagacttcactcatgaagagtggggatggctcagttctgctcagagggacttatacaaggatgtgatggtccagaattatgagaacctggtctctgtagcaggtctttctgtaactaagccatatgtgatcacgttattggaggatggaaaagagccctggatgatggagaaaaaactgtcaaaaggtatgattccagattgggaatcaagatgggaaaacaaggaattatcaacaaagaaggataattatgatgaagattcaccccaaacagtaataatagaaaaagttgtaaaacaaagttatgaattttcaaattctaagaagaatttggaatatatagagaagttggaagggaagcatggaagtcaggtagaccatttcagaccagcaattctcacctctagagaaagccccactgcagacagtgtttacaaatacaatatatttagaagcacctttcattcaaagtctactctttctgaaccacaaaaaatttctgctgaagggaattcacacaaatatgatatattaaagaagaacttaccaaaaaagtcagttataaaaaatgagaaagtcaatggtggaaagaaacttttgaattctaataaaagtggggcagccttcagccagggcaaatctcttacccttccccagacttgtaatagagagaaaatctatacatgcagtgaatgtgggaaagcctttggcaaacagtcaatcctcaatcgccactggagaattcatacaggagagaagccctatgaatgtcgtgaatgtgggaagacttttagccatggctcatcccttacacgacatctgataagccatagtggagagaaaccttacaaatgtattgaatgtgggaaggcctttagccatgtctcatcacttactaaccatcagagcactcacactggagagaaaccatatgaatgtatgaactgtggaaagtcttttagtcgtgtgtcccatcttattgaacatctaagaattcatactcaagaaaaactctatgagtgtcgtatatgtggaaaggccttcattcataggtcatctctcattcaccatcagaaaatccatactggagagaagccttatgaatgtagagaatgtgggaaagctttctgctgtagctcacaccttactcgacatcaaagaattcacactatggagaaacaatatgaatgcaacaaatgtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattagattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttaccgtacatcagagaattcacactggagaaaagccatataaatgtaatgagtgtgggaaagcttttagcaaaggctcaaatcttactgcccatcaaagagtacataatggagagaaacccaatagtgtggtaagtgtggaaaagcctttagactatatgaatcactatacatgtgagaaatcttacagaagagaaactgtatgaagcagtggttatcatggtaaatttcctagattctcccttatttaacattagaaaaatttatactggggaaagtcttatgaatgtggtga

SEQ ID NO: 34926 - DNA, 3573 bp, Homo sapiens
agtgcttgttggggccaggctttgtaacggtctcctgagcagcgagcagaaaatctgttatcgagagagacacagtgacctgcccctaaaggttcatgcgcatccctcagacccctctttagacgcgccccgcttctccctctgccctctccccttgcccaagccccgaggtgggggcctggtgtgaatgctccggccgaagtgaacctgcacccccgcacccgaaggcctctttccggcttctgggcaaggcggccccggtgagctcggccgtcacacatctctgctttttcccaagaagagcaggaaatggccaaaccccagtcctgcaagctgtacaagaagcatgacaccagcatctgcatctggtgaggactcaggaagcttctactcatggcagaaggcaaagagggaacaggggctagtgacatttgaagatgtagctgtggatttcacccaggaggagtggcagtacctgaacccaccacagaggaccctgtacagagacgtgatgctggagacctacagcaacttggtctttgtggggcagcaggttaccaaaccaaacctcatcctcaagttggaggtagaagaatgcccggcagaaggaaaaatcccattttggaactttccagaagtctgtcaagttgatgaacagattgagaggcaacatcaggatgaccaagataaatgtctgctgatgcaagttggattttctgacaagaaaacaattatcaccaagagtgctcgtgactgtcatgagtttggaaacatacttcatctgagtacaaaccttgttgcttcaatacaaagacccgataaacacgaatcatttggaaataatatggtagataatttagacttatttagtagaagttctgcagaaaataaatatgataatggatgtgcaaaattgttcttccatactgagtatgagaaaacaaatcctggaatgaagccctatggctataaagagtgtgggaaaggtcttaggcgaaagaaaggccttagtctacatcagagaattaaaaatggagagaaaccctttgaatgtactgcatgtaggaaaaccttcagcaagaagtcacacctcattgtacattggagaactcatacgggagagaaaccttttggatgtaccgaatgtggaaaagcttttagccaaaaatctcagctcattatacacttgcgaactcatacaggagagagaccctttgagtgtcctgaatgtggaaaagccttcagagaaaagtcaactgtcatcatacattacaggactcacacaggagaaaaaccttatgaatgtaatgaatgtggaaaagccttcactcagaagtccaacctcattgtccatcagaaaacccacactggagagaaaacctatgaatgcactaaatgtggagaatctttcatacagaagcttgatctaattatacatcatagtacccatacaggaaagaaaccccatgaatgtaatgagtgtaagaaaactttcagtgataagtcaactctcattatacaccagagaactcatacgggagagaaacctcataaatgtactgaatgtgggaagtctttcaatgagaagtcaaccctcattgtgcatcaaagaactcatacaggagagaaaccctatgaatgtgatgtgtgtggaaaaaccttcacgcaaaagtcaaaccttggtgtacatcagagaactcattcaggagagaaaccctttgaatgtaatgaatgtgagaaagccttctctcagaagtcctacctcatgctgcatcagagaggtcatacaggagagaaaccttacgagtgcaatgaatgtgaaaaagcattttcacagaaatcatatctcattatacatcaaagaactcatacagaagaaaaaccctataaatgtaatgaatgtggcaaagccttcagagaaaagtcaaagctcattatacatcagagaattcatacaggagagaaaccttatgaatgtcctgtgtgttggaaagcttttagccagaagtcacagctcataatacatcagagaacgcacacgggagagaaaccctatgcatgcactgagtgtggcaaagccttccgagaaaagtcaacattcactgtacatcaaagaactcatactggagagaaaccctataaatgtacagaatgtgggaaagcctttacccaaaaatcaaaccttattgtacatcagcgaacccatgcaggaaagaaagcccatggaagaggccacactcggaagtcaaagttcatggcacattagagagctaatcagcagtatctattatggacactgaaagaaagttgtgtcaattttactcacattttaaaagtatattttgacttgtggtttaaatatgggagtaaattcagcctttcttcttttcatctcagtcataacccaaaagctacgggagaaaaagcagaagtgtaatctctgtatctgacaaaattaggagacagctgcaaccctaatgagagggctgccacaggcagaggaaatgaagcactggtgcaggagatttcagagtgagagtgctcaaggctgcaggtgcaagacagcactggtaaggactcttagctgaggttcgggatataccccgaggcgcggaaccatagatataacagtggtaacagtgcgtgggcaggtaggaggtaggatgtttcctagaccatttggggtctgaggagaaacaggctggggcctcgagaaggagtcactcagacaagccatatttttagaaagtagtctactgatgggagcaacagttatggcatgctgggggaagagaagggacttttccttgtgaagagccctacagctgcccctatttactgacttgggagaagtaaagtcagaaagaacgaacagctgtggggggaaaaaattctcagttgtcaaaaaaaaaaaaaactgatctgcttagaatgtggccctggtttcttttcccacatgaacctccagcaaatagcaagtccaggaaaaactcttctcattcaaagaggaattattcaaaagtaatcaaaaccacaaatgcatttggtttttgggccagcaattccacttctaggaatgtacatactcacacatgtacaaaatgatgaacatacagtattcattaatgcagcgtttgtgaaaacaaaagattggaagctgtttaaatgacaccatatcagggttctggttccctaaattgtggtatattcatacagcctactcctgggtagacaacaatgaataaataaggagaacttggaaaccatttatgtagtgatgtgggataaccttcagtttatgttattaggtaggaaaaataaggttgaggacagtgactgccatttgtatataaaaaggagaaaaatggtaagtacataattgtgaattcataagttatctctggaaagagacatgagaacctggtaaccctgattaccttgggaggggaaggggcagtggtggctggggggatggaattgagagggagacaactgtatcctttcatagcttttgaaaatgtgggtgtactatgtactatgtggatgtactaccttttcaaaaataaaacattt

SEQ ID NO: 34927 - DNA, 3465 bp, Homo sapiens
gtaacggtctcctgagcagcgagcagaaaatctgttatcgagagagacacagtgacctgcccctaaaggttcatgcgcatccctcagacccctctttagacgcgccccgcttctccctctgccctctccccttgcccaagccccgaggtgggggcctggtgtgaatgctccggccgaagtgaacctgcacccccgcacccgaaggcctctttccggcttctgggcaaggcggccccggtgagctcggccgtcacacatctctgctttttcccaagaagagcaggaaatggccaaaccccaggggctagtgacatttgaagatgtagctgtggatttcacccaggaggagtggcagtacctgaacccaccacagaggaccctgtacagagacgtgatgctggagacctacagcaacttggtctttgtggggcagcaggttaccaaaccaaacctcatcctcaagttggaggtagaagaatgcccggcagaaggaaaaatcccattttggaactttccagaagtctgtcaagttgatgaacagattgagaggcaacatcaggatgaccaagataaatgtctgctgatgcaagttggattttctgacaagaaaacaattatcaccaagagtgctcgtgactgtcatgagtttggaaacatacttcatctgagtacaaaccttgttgcttcaatacaaagacccgataaacacgaatcatttggaaataatatggtagataatttagacttatttagtagaagttctgcagaaaataaatatgataatggatgtgcaaaattgttcttccatactgagtatgagaaaacaaatcctggaatgaagccctatggctataaagagtgtgggaaaggtcttaggcgaaagaaaggccttagtctacatcagagaattaaaaatggagagaaaccctttgaatgtactgcatgtaggaaaaccttcagcaagaagtcacacctcattgtacattggagaactcatacgggagagaaaccttttggatgtaccgaatgtggaaaagcttttagccaaaaatctcagctcattatacacttgcgaactcatacaggagagagaccctttgagtgtcctgaatgtggaaaagccttcagagaaaagtcaactgtcatcatacattacaggactcacacaggagaaaaaccttatgaatgtaatgaatgtggaaaagccttcactcagaagtccaacctcattgtccatcagaaaacccacactggagagaaaacctatgaatgcactaaatgtggagaatctttcatacagaagcttgatctaattatacatcatagtacccatacaggaaagaaaccccatgaatgtaatgagtgtaagaaaactttcagtgataagtcaactctcattatacaccagagaactcatacgggagagaaacctcataaatgtactgaatgtgggaagtctttcaatgagaagtcaaccctcattgtgcatcaaagaactcatacaggagagaaaccctatgaatgtgatgtgtgtggaaaaaccttcacgcaaaagtcaaaccttggtgtacatcagagaactcattcaggagagaaaccctttgaatgtaatgaatgtgagaaagccttctctcagaagtcctacctcatgctgcatcagagaggtcatacaggagagaaaccttacgagtgcaatgaatgtgaaaaagcattttcacagaaatcatatctcattatacatcaaagaactcatacagaagaaaaaccctataaatgtaatgaatgtggcaaagccttcagagaaaagtcaaagctcattatacatcagagaattcatacaggagagaaaccttatgaatgtcctgtgtgttggaaagcttttagccagaagtcacagctcataatacatcagagaacgcacacgggagagaaaccctatgcatgcactgagtgtggcaaagccttccgagaaaagtcaacattcactgtacatcaaagaactcatactggagagaaaccctataaatgtacagaatgtgggaaagcctttacccaaaaatcaaaccttattgtacatcagcgaacccatgcaggaaagaaagcccatggaagaggccacactcggaagtcaaagttcatggcacattagagagctaatcagcagtatctattatggacactgaaagaaagttgtgtcaattttactcacattttaaaagtatattttgacttgtggtttaaatatgggagtaaattcagcctttcttcttttcatctcagtcataacccaaaagctacgggagaaaaagcagaagtgtaatctctgtatctgacaaaattaggagacagctgcaaccctaatgagagggctgccacaggcagaggaaatgaagcactggtgcaggagatttcagagtgagagtgctcaaggctgcaggtgcaagacagcactggtaaggactcttagctgaggttcgggatataccccgaggcgcggaaccatagatataacagtggtaacagtgcgtgggcaggtaggaggtaggatgtttcctagaccatttggggtctgaggagaaacaggctggggcctcgagaaggagtcactcagacaagccatatttttagaaagtagtctactgatgggagcaacagttatggcatgctgggggaagagaagggacttttccttgtgaagagccctacagctgcccctatttactgacttgggagaagtaaagtcagaaagaacgaacagctgtggggggaaaaaattctcagttgtcaaaaaaaaaaaaaactgatctgcttagaatgtggccctggtttcttttcccacatgaacctccagcaaatagcaagtccaggaaaaactcttctcattcaaagaggaattattcaaaagtaatcaaaaccacaaatgcatttggtttttgggccagcaattccacttctaggaatgtacatactcacacatgtacaaaatgatgaacatacagtattcattaatgcagcgtttgtgaaaacaaaagattggaagctgtttaaatgacaccatatcagggttctggttccctaaattgtggtatattcatacagcctactcctgggtagacaacaatgaataaataaggagaacttggaaaccatttatgtagtgatgtgggataaccttcagtttatgttattaggtaggaaaaataaggttgaggacagtgactgccatttgtatataaaaaggagaaaaatggtaagtacataattgtgaattcataagttatctctggaaagagacatgagaacctggtaaccctgattaccttgggaggggaaggggcagtggtggctggggggatggaattgagagggagacaactgtatcctttcatagcttttgaaaatgtgggtgtactatgtactatgtggatgtactaccttttcaaaaataaaacatttaaaaagcta

SEQ ID NO: 34928 - DNA, 3586 bp, Homo sapiens
agtgcttgttggggccaggctttgtaacggtctcctgagcagcgagcagaaaatctgttatcgagagagagtgagcacagtgacctgcccctaaaggttcatgcgcatccctcagacccctctttagacgcgccccgcttctccctctgccctctccccttgcccaagccccgaggtgggggcctggtgtgaatgctccggccgaagtgaacctgcacccccgcacccgaaggcctctttccggcttctgggcaaggcggccccggtgagctcggccgtcacacatctctgctttttcccaagaagagcaggaaatggccaaaccccagtcctgcaagctgtacaagaagcatgacaccagcatctgcatctggtgaggactcaggaagcttctactcatggcagaaggcaaagagggaacaggggctagtgacatttgaagatgtagctgtggatttcacccaggaggagtggcagtacctgaacccaccacagaggaccctgtacagagacgtgatgctggagacctacagcaacttggtctttgtggggcagcaggttaccaaaccaaacctcatcctcaagttggaggtagaagaatgcccggcagaaggaaaaatcccattttggaactttccagaagtctgtcaagttgatgaacagattgagaggcaacatcaggatgaccaagataaatgtctgctgatgcaagttggattttctgacaagaaaacaattatcaccaagagtgctcgtgactgtcatgagtttggaaacatacttcatctgagtacaaaccttgttgcttcaatacaaagacccgataaacacgaatcatttggaaataatatggtagataatttagacttatttagtagaagttctgcagaaaataaatatgataatggatgtgcaaaattgttcttccatactgagtatgagaaaacaaatcctggaatgaagccctatggctataaagagtgtgggaaaggtcttaggcgaaagaaaggccttagtctacatcagagaattaaaaatggagagaaaccctttgaatgtactgcatgtaggaaaaccttcagcaagaagtcacacctcattgtacattggagaactcatacgggagagaaaccttttggatgtaccgaatgtggaaaagcttttagccaaaaatctcagctcattatacacttgcgaactcatacaggagagagaccctttgagtgtcctgaatgtggaaaagccttcagagaaaagtcaactgtcatcatacattacaggactcacacaggagaaaaaccttatgaatgtaatgaatgtggaaaagccttcactcagaagtccaacctcattgtccatcagaaaacccacactggagagaaaacctatgaatgcactaaatgtggagaatctttcatacagaagcttgatctaattatacatcatagtacccatacaggaaagaaaccccatgaatgtaatgagtgtaagaaaactttcagtgataagtcaactctcattatacaccagagaactcatacgggagagaaacctcataaatgtactgaatgtgggaagtctttcaatgagaagtcaaccctcattgtgcatcaaagaactcatacaggagagaaaccctatgaatgtgatgtgtgtggaaaaaccttcacgcaaaagtcaaaccttggtgtacatcagagaactcattcaggagagaaaccctttgaatgtaatgaatgtgagaaagccttctctcagaagtcctacctcatgctgcatcagagaggtcatacaggagagaaaccttacgagtgcaatgaatgtgaaaaagcattttcacagaaatcatatctcattatacatcaaagaactcatacagaagaaaaaccctataaatgtaatgaatgtggcaaagccttcagagaaaagtcaaagctcattatacatcagagaattcatacaggagagaaaccttatgaatgtcctgtgtgttggaaagcttttagccagaagtcacagctcataatacatcagagaacgcacacgggagagaaaccctatgcatgcactgagtgtggcaaagccttccgagaaaagtcaacattcactgtacatcaaagaactcatactggagagaaaccctataaatgtacagaatgtgggaaagcctttacccaaaaatcaaaccttattgtacatcagcgaacccatgcaggaaagaaagcccatggaagaggccacactcggaagtcaaagttcatggcacattagagagctaatcagcagtatctattatggacactgaaagaaagttgtgtcaattttactcacattttaaaagtatattttgacttgtggtttaaatatgggagtaaattcagcctttcttcttttcatctcagtcataacccaaaagctacgggagaaaaagcagaagtgtaatctctgtatctgacaaaattaggagacagctgcaaccctaatgagagggctgccacaggcagaggaaatgaagcactggtgcaggagatttcagagtgagagtgctcaaggctgcaggtgcaagacagcactggtaaggactcttagctgaggttcgggatataccccgaggcgcggaaccatagatataacagtggtaacagtgcgtgggcaggtaggaggtaggatgtttcctagaccatttggggtctgaggagaaacaggctggggcctcgagaaggagtcactcagacaagccatatttttagaaagtagtctactgatgggagcaacagttatggcatgctgggggaagagaagggacttttccttgtgaagagccctacagctgcccctatttactgacttgggagaagtaaagtcagaaagaacgaacagctgtggggggaaaaaattctcagttgtcaaaaaaaaaaaaaactgatctgcttagaatgtggccctggtttcttttcccacatgaacctccagcaaatagcaagtccaggaaaaactcttctcattcaaagaggaattattcaaaagtaatcaaaaccacaaatgcatttggtttttgggccagcaattccacttctaggaatgtacatactcacacatgtacaaaatgatgaacatacagtattcattaatgcagcgtttgtgaaaacaaaagattggaagctgtttaaatgacaccatatcagggttctggttccctaaattgtggtatattcatacagcctactcctgggtagacaacaatgaataaataaggagaacttggaaaccatttatgtagtgatgtgggataaccttcagtttatgttattaggtaggaaaaataaggttgaggacagtgactgccatttgtatataaaaaggagaaaaatggtaagtacataattgtgaattcataagttatctctggaaagagacatgagaacctggtaaccctgattaccttgggaggggaaggggcagtggtggctggggggatggaattgagagggagacaactgtatcctttcatagcttttgaaaatgtgggtgtactatgtactatgtggatgtactaccttttcaaaaataaaacatttaaaaagct

SEQ ID NO: 34929 - DNA, 3101 bp, Homo sapiens
gttgaagccggttgtaggcgtggaaagaggttggcgcgctggaagtccagttgcttcggctccctgcgttaggtctggtggcggtcaatgcgcttccggacccgggatcagagtgtgtggatcgctatagggggaggggagctcagggtagacaacctcagcgtgttgcagattccctgcaaggggagttagacatctgagtcctagaccgagataccagctgaaggaacgctgcctggcgaaccctggtgttcaagttccagaggaacgggatgagctcctgagatggaagatctgtcctctccagactccacccttctccaagggggacataatctactctcatcagccagttttcaggaagcggtgactttcaaggatgtgatagtggactttacccaggaagaatggaaacagctggaccctggccagagagatttgttcagggatgtgacattggaaaattatacacacctggtctctataggactccaagtttctaaacctgatgtgatttcccagttagagcaagggacagagccatggatcatggagccaagcattccagtaggtacctgtgcagactgggagacaagacttgaaaatagtgtgtcagccccagagcctgacatttctgaagaagagctatctccagaggtaatagtggaaaaacacaaaagagatgattcttggagttccaacttgctagaaagttgggaatatgaaggcagtttagagagacagcaggcaaaccaacagacactgccaaaggaaataaaggtaaccgaaaagacaatacccagttgggaaaaaggccctgtaaataatgaatttgggaaaagtgtcaatgtgagttcaaaccttgtaacacaagaaccatctccagaagagacctctactaaaagaagcatcaaacagaattcaaacccagttaaaaaagagaaatcttgtaagtgcaatgaatgtgggaaagcctttagttattgttcagctcttattcgccatcagagaacacatactggagaaaaaccctacaaatgtaatgaatgtgaaaaagccttcagccggagtgaaaaccttataaaccatcaaagaattcatactggagataaaccatataaatgtgatcagtgtggaaaaggcttcattgagggtccatctcttactcaacatcaaagaattcatactggagaaaaaccatataaatgtgatgaatgtgggaaagcctttagtcagaggacccatcttgttcagcatcagagaattcatactggcgagaagccatacacttgtaatgagtgtggaaaagcctttagccagagaggccactttatggaacatcagaaaattcatacgggagaaaaaccttttaaatgtgatgaatgtgataaaaccttcaccaggagcacacaccttactcaacatcaaaaaattcatactggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactggggagaaaccctatgattgtgcagaatgtggaaaatcttttagttactggtcatcccttgctcaacacctgaaaattcatactggagaaaaaccttacaaatgcaatgaatgtggaaaggccttcagttactgctcatcccttactcaacatcggagaattcacacgagagaaaagccctttgaatgcagtgaatgtggaaaggctttcagttatctctcaaaccttaatcagcatcagaaaactcatactcaagagaaagcttatgaatgtaaagaatgtgggaaagcttttattcggagttcatctcttgctaagcatgaaagaattcatactggagagaaaccctatcagtgtcatgaatgtgggaaaaccttcagttatggttcatcccttattcagcataggaagatccatactggagaacgaccttacaagtgtaatgagtgtgggagagcattcaaccagaacatacaccttacacagcataagagaattcatacaggagccaagccttatgagtgtgctgagtgtggtaaagcctttcgacattgttcatctcttgctcaacatcaaaaaactcacacagaagaaaaaccctaccagtgtaataaatgtgaaaagacctttagccagagctcccatctaactcagcatcaacgaattcacactggggagaagccctataagtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaacatcagagactgcatcctggcatatgacaattctaggaacatcataaatttaggggagatatttactttagtttgtccttttgttaagtactgaagaatcagagtggatttagaaactgccttgaaatcttttaaattttcactatcatgttatggaatggaaagtacattgggctgaactaatccaattgttattaagccactctgtgacattagaaaactctactgttttaagctttagtttcctttatggaatgaaggatttggagtagattatttcaaaggtagtttggagttttataatcagttttgtatatttacaatattttcttgaatgggtttactatacatcagcattttgctgtgttgcatctagaatgtgtatgtttatgcatgttttgccaatagaatttgtgcttcagtaactagatcggggatctagtatgctcctggtctaatgcatttacattgtttaggtaactggttcctaataaaaagaattataaaataccctcaaattaacaattcaattgcatataatagcctaactcagtaagaatattaaaacttactattattcttcttct

SEQ ID NO: 34930 - DNA, 2289 bp, Homo sapiens
gttgaagccggttgtaggcgtggaaagaggttggcgcgctggaagtccagttgcttcggctccctgcgttaggtctggtggcggtcaatgcgcttccggacccgggatcagagtgtgtggatcgctatagggggaggggagctcagggtagacaacctcagcgtgttgcagattccctgcaaggggagttagacatctgagtcctagaccgagataccagctgaaggaacgctgcctggcgaaccctggtgttcaagttccagaggaacgggatgagctcctgagatggaagatctgtcctctccagactccacccttctccaagggggacataatctactctcatcagccagttttcaggaagcggtgactttcaaggatgtgatagtggactttacccaggaagaatggaaacagctggaccctggccagagagatttgttcagggatgtgacattggaaaattatacacacctggtctctataggactccaagtttctaaacctgatgtgatttcccagttagagcaagggacagagccatggatcatggagccaagcattccagtaggtacctgtgcagactgggagacaagacttgaaaatagtgtgtcagccccagagcctgacatttctgaagaagagctatctccagaggtaatagtggaaaaacacaaaagagatgattcttggagttccaacttgctagaaagttgggaatatgaaggcagtttagagagacagcaggcaaaccaacagacactgccaaaggaaataaaggtaaccgaaaagacaatacccagttgggaaaaaggccctgtaaataatgaatttgggaaaagtgtcaatgtgagttcaaaccttgtaacacaagaaccatctccagaagagacctctactaaaagaagcatcaaacagaattcaaacccagttaaaaaagagaaatcttgtaagtgcaatgaatgtgggaaagcctttagttattgttcagctcttattcgccatcagagaacacatactggagaaaaaccctacaaatgtaatgaatgtgaaaaagccttcagccggagtgaaaaccttataaaccatcaaagaattcatactggagataaaccatataaatgtgatcagtgtggaaaaggcttcattgagggtccatctcttactcaacatcaaagaattcatactggagaaaaaccatataaatgtgatgaatgtgggaaagcctttagtcagaggacccatcttgttcagcatcagagaattcatactggcgagaagccatacacttgtaatgagtgtggaaaagcctttagccagagaggccactttatggaacatcagaaaattcatacgggagaaaaaccttttaaatgtgatgaatgtgataaaaccttcaccaggagcacacaccttactcaacatcaaaaaattcatactggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactcaagagaaagcttatgaatgtaaagaatgtgggaaagcttttattcggagttcatctcttgctaagcatgaaagaattcatactggagagaaaccctatcagtgtcatgaatgtgggaaaaccttcagttatggttcatcccttattcagcataggaagatccatactggagaacgaccttacaagtgtaatgagtgtgggagagcattcaaccagaacatacaccttacacagcataagagaattcatacaggagccaagccttatgagtgtgctgagtgtggtaaagcctttcgacattgttcatctcttgctcaacatcaaaaaactcacacagaagaaaaaccctaccagtgtaataaatgtgaaaagacctttagccagagctcccatctaactcagcatcaacgaattcacactggggagaagccctataagtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaacatcagagactgcatcctggcatatga

SEQ ID NO: 34931 - DNA, 2899 bp, Homo sapiens
tgcacagagggaacacaccagggtagacaacctcagcgtgttgcagattccctgcaaggggagttagacatctgagtcctagaccgagataccagctgaaggaacgctgcctggcgaaccctggtgttcaagttccagaggaacgggatgagctcctgagatggaagatctgtcctctccagactccacccttctccaagggggacataatctactctcatcagccagttttcaggaagcggtgactttcaaggatgtgatagtggactttacccaggaagaatggaaacagctggaccctggccagagagatttgttcagggatgtgacattggaaaattatacacacctggtctctataggactccaagtttctaaacctgatgtgatttcccagttagagcaagggacagagccatggatcatggagccaagcattccagtaggtacctgtgcagactgggagacaagacttgaaaatagtgtgtcagccccagagcctgacatttctgaagaagagctatctccagaggtaatagtggaaaaacacaaaagagatgattcttggagttccaacttgctagaaagttgggaatatgaaggcagtttagagagacagcaggcaaaccaacagacactgccaaaggaaataaaggtaaccgaaaagacaatacccagttgggaaaaaggccctgtaaataatgaatttgggaaaagtgtcaatgtgagttcaaaccttgtaacacaagaaccatctccagaagagacctctactaaaagaagcatcaaacagaattcaaacccagttaaaaaagagaaatcttgtaagtgcaatgaatgtgggaaagcctttagttattgttcagctcttattcgccatcagagaacacatactggagaaaaaccctacaaatgtaatgaatgtgaaaaagccttcagccggagtgaaaaccttataaaccatcaaagaattcatactggagataaaccatataaatgtgatcagtgtggaaaaggcttcattgagggtccatctcttactcaacatcaaagaattcatactggagaaaaaccatataaatgtgatgaatgtgggaaagcctttagtcagaggacccatcttgttcagcatcagagaattcatactggcgagaagccatacacttgtaatgagtgtggaaaagcctttagccagagaggccactttatggaacatcagaaaattcatacgggagaaaaaccttttaaatgtgatgaatgtgataaaaccttcaccaggagcacacaccttactcaacatcaaaaaattcatactggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactggggagaaaccctatgattgtgcagaatgtggaaaatcttttagttactggtcatcccttgctcaacacctgaaaattcatactggagaaaaaccttacaaatgcaatgaatgtggaaaggccttcagttactgctcatcccttactcaacatcggagaattcacacgagagaaaagccctttgaatgcagtgaatgtggaaaggctttcagttatctctcaaaccttaatcagcatcagaaaactcatactcaagagaaagcttatgaatgtaaagaatgtgggaaagcttttattcggagttcatctcttgctaagcatgaaagaattcatactggagagaaaccctatcagtgtcatgaatgtgggaaaaccttcagttatggttcatcccttattcagcataggaagatccatactggagaacgaccttacaagtgtaatgagtgtgggagagcattcaaccagaacatacaccttacacagcataagagaattcatacaggagccaagccttatgagtgtgctgagtgtggtaaagcctttcgacattgttcatctcttgctcaacatcaaaaaactcacacagaagaaaaaccctaccagtgtaataaatgtgaaaagacctttagccagagctcccatctaactcagcatcaacgaattcacactggggagaagccctataagtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaacatcagagactgcatcctggcatatgacaattctaggaacatcataaatttaggggagatatttactttagtttgtccttttgttaagtactgaagaatcagagtggatttagaaactgccttgaaatcttttaaattttcactatcatgttatggaatggaaagtacattgggctgaactaatccaattgttattaagccactctgtgacattagaaaactctactgttttaagctttagtttcctttatggaatgaaggatttggagtagattatttcaaaggtagtttggagttttataatcagttttgtatatttacaatattttcttgaatgggtttactatacatcagcattttgctgtgttgcatctagaatgtgtatgtttatgcatgttttgccaatagaatttgtgcttcagtaactagatcggggatctagtatgctcctggtctaatgcatttacattgtttaggtaactggttcctaataaaaagaattataaaata

SEQ ID NO: 34932 - DNA, 234 bp, Homo sapiens
aaagcctttagtcagaggacccatcttgttcagcatcagagaattcatactggcgagaagccatacacttgtaatgagtgtggaaaagcctttagccagagaggccactttatggaacatcagaaaattcatacgggagaaaaaccttttaaatgtgatgaatgtgataaaaccttcaccaggagcacacaccttactacatcaaaaaattcatactggagaaaaaacctataa

SEQ ID NO: 34933 - DNA, 3115 bp, Homo sapiens
gcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaagagagacttgataaatcggcctgagaaaataagtaatgctccagactagctctctcatttgtgagttctccaggtgaagcaccatttttgaccttcccttgtgtcttctgttcctggcacagtgcctggaccccaaggaggagtgggattatctggacccagctcagagaagcctgtataaagatgtcatgatggagaattatggaaacctggtctcactggatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaaaagcttcagccggagctcatttcttattgaacatcagagaatccacactggtgagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagaagatccatgcagaggtgaaaacccaagaaacccatgaatgtgacgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatgggtcagatttagtgataaagcaaattctccttggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttagctttg

SEQ ID NO: 34934 - DNA, 3021 bp, Homo sapiens
gcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaaggggttgctgacatttgaggatgtggctgtgttttttacccaggaggagtgggattatctggacccagctcagagaagcctgtataaagatgtcatgatggagaattatggaaacctggtctcactggatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaaaagcttcagccggagctcatttcttattgaacatcagagaatccacactggtgagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagaagatccatgcagaggtgaaaacccaagaaacccatgaatgtgacgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatgggtcagatttagtgataaagcaaattctccttggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttagctttg

SEQ ID NO: 34935 - DNA, 3134 bp, Homo sapiens
aaggaggaggaactggcagcggggaggaggctctagcgaggcctgaaaggctgcgtaaccaggcaggagtaggggttggggttcggggttgggggacagccagggatcgcgtctgatatgctgttggggtcgtgaccgtctgggggccgaggcaggcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaaggaggagtgggattatctggacccagctcagagaagcctgtataaagatgtcatgatggagaattatggaaacctggtctcactggatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaaaagcttcagccggagctcatttcttattgaacatcagagaatccacactggtgagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagaagatccatgcagaggtgaaaacccaagaaacccatgaatgtgacgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatgggtcagatttagtgataaagcaaattctccttggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttagctttg

SEQ ID NO: 34936 - DNA, 3220 bp, Homo sapiens
acttccggcctcctaaccgttctcgctagcggtgcgcttctggcctgttttgagtccgcgctcaaaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgacttcccagaaacacgtaatgtggaaaagcaccaggacatccccacagtgaaaaatatccaaggaaaggttccaagaatcccctgtgcaaggaaacctttcatatgtgaggagtgtgggaaatccttcagctacttttcttactatgctagacaccagagaatccacactggggagaaaccttttgagtgtagtgagtgtggaaaagcctttaatggtaattcttcgttaattcggcaccagaggattcacactggagagagaccctatcagtgtgaggagtgtgggcgagcctttaatgataatgcaaatctgatcaggcatcagagaatccacagtggggacagaccctattactgtacagagtgtgggaatagtttcacgagtagttccgagtttgttatacatcagagaatccacactggggagaaaccctatgagtgtaatgagtgtggcaaagcttttgttggtaattcacccctacttcggcatcagaaaatccacactggagagaaaccctatgagtgtaatgagtgtggcaaaagctttggaaggacttcccatctaagccaacatcagcgtattcacacaggggaaaagccttattcttgtaaagtatgtggacaagccttcaattttcatacaaaactaactcggcaccagagaattcacagtgaggagaaaccctttgactgtgtagattgtggaaaagccttcagtgctcaggaacaattaaaaaggcatctgagaattcatactcaggagtcttcctatgtatgtgatgagtgtggaaaagccttgactagcaaaagaaatcttcatcagcatcaaagaatccatactggagagaaaccctatgagtgtagcaagtatgagaaggcctttgggacttcttcccagctaggtcaccttgagcatgtctactctggagagaagcctgtgctggacatttgtcgttttggcctcccagaattttttacccccttttactggtaatagtacactccagtgaaatgtactgagtggattccgtcttctactcaggaatggaatgtgtgacacaggcctgactcagcctctgatccatccctcaagccacagttaatgattcagatgtcagtagatgaccaaagatggttcaattagagtcccaggattgcaagagctaataggaacaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatacgggtttttgaattgcagcagccaataaattccatttttgtttggttggttttggctttggcacacctgagttaggttttcttgccttggaacagaattttgacttaaacagtgttgtcattgtagcagttgtttgaagttttcagggataacatacctgatggagaaatgttttgtgtgtatgatatatgggaaagtctttagttatagtcatggcagctcctcaaccccatgattgtgatgagattgggaagcccactgtaacactggagagcccaggttatatcagacaccactagtagatagaagttctaacaacttgagctctgtaacaaaaatctcattgtactacaaaattatgtctgcaccagtgaatccattctcaagaaaagtcttaactaggaaactaaaagctttcactcttaaagctttcattttctgtttattcagttttttatttggaatggatgctactctaggccttaaactgagaaatgccaggctattgtagctattatatcttggtatttgccattttaattcctaggacagcacgcccgctttgcccttgacctggctagggagccaaggaaatgccatggttcttggtcataagacacactgcagagatctctcagtaggaaaacagggctggcccttttctttggtgatgaacacaaactgcaccctttttttctcccacgtgtccttccgctgccagccagtgttggaatctccctacccaattccagacttaattgcttactgcgtctagcacctgggtggcttcaccacctcttccttacttgtcagcagatgaatgagcagttgtatcatgtgcttgggttgaccaatgaatgatagacttggggaattgagtaaacaccttttaattgaagtataacacaaacataaaaatgcatgagtcagccaggcgcggtggctcacacttgtaatcccagtactttgggaggccgaggtgggcgattcatcaggtcaagagatcgagaccatcctggccaacatggtgaaaccccgtctctactaaaaatacaagaattagctgggcgtggtggtgcatgcctgtagtcccagctgctcaggaagctggggcaggcgaattgcttgaacccgggaggcggaggttgtagtgagccgagattacaccactgcactccagcctggtgacagagtgagattcctcaataaaataaaataaaaccatgaa
